United States Patent 7,745,391 (HUMAN THROMBOSPONDIN POLYPEPTIDE) - sequence listing, part 23

SEQ ID NO: 56300 - DNA, 1840 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcgtgagtgcctggtccttccacccccatggggcgagactgtcgggcatgggtatggggtgccagagggctctggccacctggggcttgctgtcctgagagccccagcacccatgtcacccccaacagctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggactcctgtcggggggatgagcacagggtgcgttctggcggggtcctggcctcgggagagagtgtgggtgtgggcccacccttcagttcccacacagctgtctgggcagccaggacctcgttcacccaggaggcctgcagggtttgggaacagagtacagtgaggaggcccaagtgacagctgtggctgaggaggggttggggcccgtgagccgtggggcctcccgcacccgtggacacgcgagcctcatgtgcacacctgcccccagctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56301 - DNA, 1294 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgacttctcggcgagaaaagaaaaagcttccaggc

SEQ ID NO: 56302 - DNA, 1385 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtgggtgggtgtccctcccagccaggcagagccccgcagtgcccgagaccctcccagccaggcggagccccgcagtgcccctgaggccctcagcccccacatgccctgtgctgcactcccagggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56303 - DNA, 1173 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgaggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56304 - DNA, 1043 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtgcagctgcctgtctggtgtctgtctttggtgtcagaactttgggggccgggcccctccccacaataaagatgctctccgactt

SEQ ID NO: 56305 - DNA, 892 bp, Homo sapiens
gtctcagtgctgtgccccccccagagcctagaggatgtttcatgggatcccagccacgccgggcataggaggtgagtgtggctggaagggcgcaggctttcagccgcttctgcaggggctgacgggcagtattgggtattggggatcgggggtggggaggtatctgaccctgctctcgtacagccttgggggtggccaggggctaaatagttcattgcaggagcactgagggctcagaaacctccagacagaactggcttggtcctgctgggcagagatgatgagcttcggtgtggccagaacggtgggggtcctgggcaccctgtgtcaccaatcccaggggagaggctgtgtgtggtgagccttgttggcactgcatcatgagccacgagcagggcgtggccactgttgtgcaggtgactccgccagggagccatggtggagctggggagctgggcctgtcatgcggtcccccggggagccgcagtggagctggggagctgggcctgtcatgcggtcccccggggagccgcagtggagctggggagctgggcctgtcatgcggcccccggcttctcagaggtgttatcatcaggtccccccacacactgataggggtgaggttggaacctctgtgctccagctccctctgggctctttgggacccagcctgggaggcctcagggaggaactgaaatggagactgggactggagtctgcccttgggttccctttggggccagcctgccagctctctgccttctcttgcagcccctgggaacaagccggagctgtatgaggtgagtggtgggtgcccacccggccggcattggccaacagcaaatgcctgtgtggcctcaccagggtcctgcagcccctgttggcactggcc

SEQ ID NO: 56306 - DNA, 1283 bp, Homo sapiens
  misc_feature (4)..(4): n is a, c, g, or t
  misc_feature (6)..(7): n is a, c, g, or t
ggcncnnggccgaggtcgggatgtgacttgtctgcggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgcgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtaccta

SEQ ID NO: 56307 - DNA, 395 bp, Homo sapiens
  misc_feature (27)..(27): n is a, c, g, or t
gcggccgactactactactactactantaaattcgcggccgcgtcgacgcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtaccta

SEQ ID NO: 56308 - DNA, 1481 bp, Homo sapiens
atccaacctcctccttcccctcctcaggcgccttcccctcccccagggccttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgcgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtaccta

SEQ ID NO: 56309 - DNA, 1422 bp, Homo sapiens
cacaaggatgggtcagcgctgcgcagcgagagccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgcgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtaccta

SEQ ID NO: 56310 - DNA, 1804 bp, Homo sapiens
atccaacctcctccttcccctcctcaggcgccttcccctcccccagggccttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgcgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacctatctggtgtgttgtgtttttttttcccccgccgatgtctctgccaccacgtggccctctcagtttcccctccctcagttccctcttgcctccatgaatcaccctccctggcccagcttggattgccatctcaaagccaggtctgggcatgccttgctgtcctggccaggtgggtgggctttccccatctccagagaacaaaatgcatctctctctctgtgtctgtctgtctctctgtgcgtgcgtatgtgtgtctccctcaccctgtgtgtctctgctctgtgcgtggcccccgtggctgctttcccctcagcacaccctgaaa

SEQ ID NO: 56311 - DNA, 1563 bp, Homo sapiens
atccaacctcctccttcccctcctcaggcgccttcccctcccccagggccttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgcgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggagggccctttcatgtcgagtgctttcatcccctaccaagaaagatttgaggaagagttcctgtggtggctcagtggtaacgaacctcactagtatccatgaggttgtggatttgatccctggcctcgctcagtgggttgaggaggcatgaaagcgctggacatgaatcatatccagggctttcatcccccctcactcaccccacttctagatggaccagccgggcatgaagggtctcgacatgaatcatgtccaggcctttcatgcctgcctaattagtctccagtctctcatccttctttttctggttcagatgtgatagtggtttcaggccgagtttgaacagagagagtacttccggggtcactgactggctgttgggctgagtccttctaacaatatgaccttcacgggatgaagcatctcgatatgaa

SEQ ID NO: 56312 - DNA, 1057 bp, Homo sapiens
agtttttgtggggatgaaatatggaaagtaccttaaaacaatatagctaaaggtgattttactcaataccatattatttcagaaaccaagatcagatcatgataaaaagtatgaagagaaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaaaatttgctt

SEQ ID NO: 56313 - DNA, 1472 bp, Homo sapiens
ttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacgatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagacgcaatagaagttcttcaacaactgctttcaaagagacaggtggacattcacattatggtaatttaaagtatatatagttgttataaattacttgccataaaatattataattaacataatttgagggatatttttgatgataagcaatggtatataccttcttatgtgaattgcttgttagcataaaagaaactaccagtttggttcctgcgcctgctttaaataagcctgcttttgaacaagttcctgagaactttcataaccattaaagtcactaatttgaaagattctt

SEQ ID NO: 56314 - DNA, 450 bp, Homo sapiens
cagggtttaaacctcccttaagggatctaggggagacaagaataccatattgtcccaaatggagcatggaggcactgtgggctatgatagactgtcttcaaggaaaacaactctatgctgtgtccatggtaagtgtctcaagtagccaaaattattgtaaagctatttctgtgtcgatactttgtaaagtgtttgtttctatgcagcgtctacatgcgagagtatactaaagcatatacagctatataggatatagtttatatgtatagctttatatatacatataaagcttaattttgaggcttgttaaaatgtcttagtttatatttaacaaactgcttacccctgtggtgatataaaatatcatttatgtaattaataaaatgctcaagatgagtatcccataattaacttataatggggaaacaaatatgcaaacaagtatgaggt

SEQ ID NO: 56315 - DNA, 2212 bp, Homo sapiens
ttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacgatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagacgcaatagaagttcttcaacaactgctttcaaagagacaggtggacattcacattatgaaaccaagatcagatcatgataaaaagtatgaagagaaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaaaatttgctt

SEQ ID NO: 56316 - DNA, 1727 bp, Homo sapiens
ttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacgatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagacgcaatagaagttcttcaacaactgctttcaaagagacaggtggacattcacattatgaaaccaagatcagatcatgataaaaagtatgaagagaaacaatgggaaataaggtttgaggaattgctttcggctgaaacagacactcctcttttaccaccatatttgtcttcatctctgccttccccaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaaaatttgctt

SEQ ID NO: 56317 - DNA, 440 bp, Homo sapiens
cgcacctggcctaaaaatttgctagtttttaagtaaactggtcaaatgaattctgggtggctttataccagaataagttagtcatagatcctgagccacacagtatcagaagcctgttcatttgctagaataaatgttttctacacataccaagtcctcctacagttggccggagaaattgctgaccctaacagctgctaaccatctagaaccttatgaatcccattttagataatgctaagaaatgaaacactagaaatgtttgaggaatgtaaaactctcacactctgacagtaatgtttaaattggtatattttattaaataatgtcaaattattctccaaagttgaagatgcatatacttttcaaccagattccaatcctatacgcaagcacatatgtacacgtgtgcacgcacacacacacacacattttggata

SEQ ID NO: 56318 - DNA, 2279 bp, Homo sapiens
cggagctagtgaggatccagcccaggctccagttgtccgcggttcctcctcctgtcgctgcccgtgtgattactgagactcagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgctcccaaagtactttgtgcagtaggagggaaatctggactctttgcctgtttggataggtaaatagaaggctttcctaaatgaatgatgctaattgattttatgctttttaaatgtgcagattttctatattttaaaaatagtttgattttcctttttacttttctttgcttctttttagtttttttcttcttcctaaaatacttacgtgattgtttttattatattgtcattcattctttacaatactctcaattattaaccatctccccaagtgcacactttatccacctggttactcacaaacttttattccattttctctctttctttctttttttctttctggaaccatttacatgtttatttgagtcagaccacatcagaagagatttattattgtcaattatatcagaagatagcaaagaagagaactaggaacctgtggtgagggaactggggacaggaatgggtttgaatgaaaacagttcactagaagcgctaccaaagaaatgagaaaaaataggatgctgatataaattatgtactttgagtgtaatttgttttcttcagtgtatttttaaaagacagcattaagaaatatgtttttccccccaataacttagattaggaattgtcagactttttctataaaagaccaaacagtaaatattttagactttgtgagccatgtaatctttgtggcatctacttaactctgccattgtagtgtgagagcagccatagataatacataagtgaatgaacatggatgtgttccaataaaactttatttataaaaatagctagtgggctaaatttggcccatggtgatagcttgccaacccttaatttggtgcattatactagtaacttttatacattgaaaatatagcttgaagttatttttgctttttcttagataggattgcttcatgaaaacttttgtgtttaatacatattttttaatactgtggatttctgaccatttccaaaaatttggtagattgcttttccctttccaatgttaggaaacttgacgtttcatcaatggcaactgataaattctgcatctttaaaaaagtctcaaaatacctgtaatcccagcactttgggaggccaacacaggaggatcacttgagactggagtttgagacaagcctgggcattataacgagatcctgtccttacaaaaaatttaaaatattatctgggagtggtgttgcactcctgtagtcccagctaatcaggaggctgaggcaagaggattgcttgggcccgggagtttgaagttgcagtgagctatgaatgcaccattgcacactaacctgggtgacagaatgagaccctgttttg

SEQ ID NO: 56319 - DNA, 1105 bp, Homo sapiens
cggagctagtgaggatccagcccaggctccagttgtccgcggttcctcctcctgtcgctgcccgtgtgattactgagactcagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgctcccaaagtactttgtgcagtaggagggaaatctggactctttgcctgtttggataggcttgctagctatccatgtgatgtcttctaccatgagatgacccttcccagatgctagcaccatgttcttggacttcccagcctccagtaccttgagccaaataaactcctgttctttataaa

SEQ ID NO: 56320 - DNA, 2549 bp, Homo sapiens
agcggattttaggcgaactgagaattttgtgtgcattttctcctcataagtgatacttaaacggacacagtggaagagctggagtgtctagtgtgagcctgaatgctttggagtgtggaagagatattttttttttttgaaggaataatactattacttttgaatgactcgtgcgaaaagtctaagttatcatttgaagacccaaatttatgcacttcaaatgcaagtattcctaccctgctctgtaccagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgctcccaaagtactttgtgcagtaggagggaaatctggactctttgcctgtttggataggtaaatagaaggctttcctaaatgaatgatgctaattgattttatgctttttaaatgtgcagattttctatattttaaaaatagtttgattttcctttttacttttctttgcttctttttagtttttttcttcttcctaaaatacttacgtgattgtttttattatattgtcattcattctttacaatactctcaattattaaccatctccccaagtgcacactttatccacctggttactcacaaacttttattccattttctctctttctttctttttttctttctggaaccatttacatgtttatttgagtcagaccacatcagaagagatttattattgtcaattatatcagaagatagcaaagaagagaactaggaacctgtggtgagggaactggggacaggaatgggtttgaatgaaaacagttcactagaagcgctaccaaagaaatgagaaaaaataggatgctgatataaattatgtactttgagtgtaatttgttttcttcagtgtatttttaaaagacagcattaagaaatatgtttttccccccaataacttagattaggaattgtcagactttttctataaaagaccaaacagtaaatattttagactttgtgagccatgtaatctttgtggcatctacttaactctgccattgtagtgtgagagcagccatagataatacataagtgaatgaacatggatgtgttccaataaaactttatttataaaaatagctagtgggctaaatttggcccatggtgatagcttgccaacccttaatttggtgcattatactagtaacttttatacattgaaaatatagcttgaagttatttttgctttttcttagataggattgcttcatgaaaacttttgtgtttaatacatattttttaatactgtggatttctgaccatttccaaaaatttggtagattgcttttccctttccaatgttaggaaacttgacgtttcatcaatggcaactgataaattctgcatctttaaaaaagttgctgggattacaggcaaaagccactgcacccagcctcataatacattttaactgtaacctgaaactagtattgttgagactgggctacacatagaacattagttatgttagctacacgaattgattgtttaactcttattctgaaatgcactggttactggcataaagtaaattatattagtaaatattatgacaaaaattttcgaatatgtatttatagtgtaaaaatttttgagcagttgcctcttattttctcaactattaaaaataacaaattattgaagaataataagacctgttcatatcttttgacatagtaatcttttatcatagaatctatcataataaaattttaaaaattaaaagtattat

SEQ ID NO: 56321 - DNA, 1465 bp, Homo sapiens
agcggattttaggcgaactgagaattttgtgtgcattttctcctcataagtgatacttaaacggacacagtggaagagctggagtgtctagtgtgagcctgaatgctttggagtgtggaagagatattttttttttttgaaggaataatactattacttttgaatgactcgtgcgaaaagtctaagttatcatttgaagacccaaatttatgcacttcaaatgcaagtattcctaccctgctctgtaccagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgtgctgggattacaggcaaaagccactgcacccagcctcataatacattttaactgtaacctgaaactagtattgttgagactgggctacacatagaacattagttatgttagctacacgaattgattgtttaactcttattctgaaatgcactggttactggcataaagtaaattatattagtaaatattatgacaaaaattttcgaatatgtatttatagtgtaaaaatttttgagcagttgcctcttattttctcaactattaaaaataacaaattattgaagaataataagacctgttcatatcttttgacatagtaatcttttatcatagaatctatcataataaaattttaaaaattaaaagtattat

SEQ ID NO: 56322 - DNA, 259 bp, Homo sapiens
gccacgaccacagtgatgttccacttctctgggtggggaggtggtaccgcaggcagggccaggttggtggggctgggtggtttagaaatcctggcttccatctcagcccccgccggtgaccaccgaggtagcttttgtgtgatctgtcgtttcctccgctactcatctcatcagagaggcccgttttgtcttggtgttctatttcatctttcagacccgaagggccacatcttacttgcatggtgtgtgttcaggtttt

SEQ ID NO: 56323 - DNA, 374 bp, Homo sapiens
atcaacagtgttgcattccttctactgcccatgtgtcagtgtcagcaaaggcctcttacatcaagacctcgtagcctccatcagagcaacctgtgtgacccatcctctgattaaaggacaccatagggagagcacaaatggtgtttttcaccaccaaacccagagtgctgagatatacttgtttaccctagcagtgtttatctttgaacggtgttaggttgatttgggatacaggtttcctttcttccctcctttgatcagctagggaaaaaaaatggattttggtcaagataataagctaggtaaattctataaaacagagtaaaacattcagtgtgtaaacatgattatagacccaatattttggatccaaa

SEQ ID NO: 56324 - DNA, 125 bp, Homo sapiens
aaaattgacttagcaacacctcacttttgagcagagaaatgaaatataactgagtggtttcgtgcatgcatgcccttcctttcctccgagggcctggcatggtgctggatacagggaatctggca

SEQ ID NO: 56325 - DNA, 441 bp, Homo sapiens
ccctcaccgctcatccatcagttaacatcttggtatgttaccttccattctttcccacctccattttttacattgtcgggagattttcacctttaaaatgtgcttatcctggtagagcgttacctaagtgctaaggaataaattgacgcacggatttgtgaaattcaaatctgaccagccactagcccaatcaatacctgacagcaaagcaggtgtaaagtgttaaaccaacttcaaagtctttccaaggaaactctggaaataaacctgaagacctctgcaagaaatcactttaacagtagtgcttctccacagtgcttctaggttatttctttgtgattgcgataattaaataccttgttaatggaaagaagggaaagaaaggaagagaaagcccctacccacccccactcttagttataaaatactttctaatagtct

SEQ ID NO: 56326 - DNA, 383 bp, Homo sapiens
gaggacctatatctttgggatatacatgtttaagcaaaattaacctggcaggggagatacattgagaagggttgattgaagcagtaagagattggaagggggaaagacaaactcagaggctctggccaccatgcatggaggaaatgaggaagattactgctgtaaaattcagtgaaaaaaatccatgtgctactaggaaaagcatggacttcaaaatcagaaaaattggagttgaatcccagcccaacaactcataaactctgtgacttcaagcaaggtacccaacttccttaaacctcattttctcaacttataaaatggatgtgaaatcagcatacataattgttataaagactaaattataaaggtttttaaatgcttag

SEQ ID NO: 56327 - DNA, 303 bp, Homo sapiens
aagaaataaatgtacctacactagctagttagacttcttatgaacatggctaaagacataacttgagcctttgcaaggtgtctttggcagagatctaaaatgcattgctgatccccaccctcccctctagggaaatcgcttaggcattgtctgtgtagatatcacctggaagctagtcaaaaatgcagaatctcaggccctgtggcaagcctcctgaatcagaatctgcaatcctgacagaagctccaagtgactcatgggaacattaaagtctaagaagctctagttttagtgacatccctc

SEQ ID NO: 56328 - DNA, 352 bp, Homo sapiens
ttataaattagaattcctgtcattgatttaatcattttcctgaattacacaaagttcaattgactgattgttaacacatggagcttgcattaatctatcacattgaggtcattcaatggaagaggtacctacagccaacagcagaatagtgtcatcaagatatttctaggataatagataacatatgaaagaacagatctgactctttttatattttaataaactttcctagtgtcacagtgaaagttcctcaatgactattcccctcaagttctctcacagtgaaatcccatcagactttagtttgctttatttgcaaaacaatagtacaaatctctccttaaataggtta

SEQ ID NO: 56329 - DNA, 208 bp, Homo sapiens
attcttttgcatatgaatattttcttttttcagcatcctttcttaaagagactgttaactaaatgaataaaagaaaatccacaaaggagaaaaaaagtatttgcaaactacccatctgacaaggaattaataaccagattatataaggagctccaaaaacactcaataacaaaacaaaacaaaaacaaaacaataacaaaacaataca

SEQ ID NO: 56330 - DNA, 227 bp, Homo sapiens
gtgctgcctatgaatattatcttatatggcctaagggtctgagacctttaacttaatcacattttatgtcatataaggtaatattcacaggttccagggattaggacatgggcatatcttttgggaagggaccattcaacgcactacacccttcttccaaatcatgtaagaatcttagcatacctaaacttgaatcactcctcctaacttatgttattgttggccgg

SEQ ID NO: 56331 - DNA, 332 bp, Homo sapiens
catttctggagttatgttcaaggcaagtggtggagttaaaattgttagcgctcatagttgtcacagaaagacaaacagtgtaatgacttgaagatatacttggattattttattttttataaaataagaaaaatcagaagaaaggtgtttaacattgattaagtcctataatagaaaaccttaatcctaggaagtatgaatggagtacgaaagctttcccatatgcattacagggaattaaaatacacaatacacttaacctagagagatcacgattgcaaatgagatactgttattcttattggtgtgctccatttttattacttcacctc

SEQ ID NO: 56332 - DNA, 417 bp, Homo sapiens
gaggccttgctttcagggatataacttccttccatcttttatctctgccttcccctaactggtatcctggaagttgggatgctgccctgtgagttaacacagagaagagtcactggagagagaacaacagttctgttcatgttttaatgtcaagtttgaaatgagtcacttcctctcactttcccttggctggttcttagccaggtgaaacatctattcttagaggacctgggacctggatggccatgagccaagcttacctatgtggaaaagagggagcaccagcactatccgaagaggagaaaaggacacgggaacattcagtggattccatcgtcattgccaatgttttcagaacttgcggttcttacatcataaccaagatttctgccctcgattataaaccagggcctgcat

SEQ ID NO: 56333 - DNA, 391 bp, Homo sapiens
tttatatatagcataccatactgccttggtgagagtcttgaacttcatcctgactgaggacagccctgaaccaattcatggggtcatgggaatgctgtgagctaacgaaatcattctggcaaaggataaggggaagagctaatgaaatcattctggctagggatgaaggaaagagaagggcttttccagttgaccttgatcagttaaaacttagccctcaagttgaatacgaagctcagtctactccacccaaactgttgttgggtagaatatacatgatggggaagaaattgaatgaatattgacaagacacacagtgtctacaacagctagtaaaatactttacatgtttttttgttgttttgttttttgggttttttttgagatggtg

SEQ ID NO: 56334 - DNA, 906 bp, Homo sapiens
cgctatatataaggtggggaggccgccggcccgttcggttccgggcgttaccatcgtccgtgcgcaccgcccggcgtccaggtgagtctcccatctgcagagacgcggacgcgccggcccgcagttggcctgcggagcgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaagattaggtatatatttaaatggaagagaaaatatttttatgggagaaaaatacatttgaaccatgaaatttcatcttttaaataacatccagtacagatatctgtgta

SEQ ID NO: 56335 - DNA, 709 bp, Homo sapiens
cgctatatataaggtggggaggccgccggcccgttcggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaaaaaaaaaaagggacacaaaaaaactctcccaaggct

SEQ ID NO: 56336 - DNA, 645 bp, Homo sapiens
aaacaacacagaacacgcaacccccaaatcccccacacaccaaaccacatttcatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaa

SEQ ID NO: 56337 - DNA, 777 bp, Homo sapiens
aaatacaaacaacgacccactcaatccaccaactgccacgacaacacgcccaaccgcctttcgacgatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaagattaggtatatatttaaatggaagagaaaatatttttatgggagaaaaatacatttgaaccatgaaatttcatcttttaaataacatccagtacagatatctgtgta

SEQ ID NO: 56338 - DNA, 1111 bp, Homo sapiens
cgctatatataaggtggggaggccgccggcccgttcggttccgggcgttaccatcgtccgtgcgcaccgcccggcgtccaggtgagtctcccatctgcagagacgcggacgcgccggcccgcagttggcctgcggagcgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaaggtattgttaaattaaaaacaaatgatttatattttgcccaaaccttagcacctttgtgagcaaaatagatttagtaccttacccttattgtgtaacttagatcaattgtgccttcatcgagtaattaaaatgaggaaattttaagagcctactctatgccaggagcattgtccatccactcatgagaagcatatacacttttggaactatggctcacataatacctggcaaacttaaaaatctggataccggccaggcacggtgtctcacacctgtaatgccaacactttgggaggccgaggcgggtggatcacttgaagtcaggagttcgagaccagcttggccaacatggtgaaattccatctttactaaaaatacaaaaattagctgggtgtagtagaacgcacctgtaaacccagctactggagaggctgaggcacgaaaattgcttgaacatgggaggcggaggctgcagtgagttgcagttgtgccactgcactccagcctgggcaacacagcaagactgtcttaaaaaaaaatctggatactgctaagtgaaagtagggcacatgtgtttgatctttccctctgatctcataacacttaggagcccaagggctttgtaaaaagatggactgatagaaaccagctcacattactattttgtgcatgttttagatatggaaagaggtaggtacaaacacaa

SEQ ID NO: 56339 - DNA, 243 bp, Homo sapiens
ttcatgactgtggcggcgggtggagcctcatctttcgctgtgtattctctttggaaaaccgatgtgatgtaagtaggtctcaatttataaaaacgtttttggcagtgtttggatgacttttagtttatgaaatgtataagtttcctatttttttcccatggatgagaatgccaaattgtgaactgggagtcagggttaaaaagcatcttttatcagaaaactcttatgatattgtctaccaat

SEQ ID NO: 56340 - DNA, 673 bp, Homo sapiens
cgctatatataaggtggggaggccgccggcccgttcggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaa

SEQ ID NO: 56341 - DNA, 1026 bp, Homo sapiens
cccggcggcgcgtggtgtcgggtctgaaaaccctacgcgactccgaagatttattttcagaaccatccttccagcacactccctctcccctctagcccgcacacagaggctgggcttagccttggggaagatctgcctttggactctcacacccctgtttacactcacagtaccattgtccagttctgggcagaccaccccaaggcctgcccaatccctcccccgcccccaactctacatccttctctgcctttgtaagggactttacgctttggctctctcacccacctgaggcccatgagtgagaaactctgagacctgtgccacgtgccagagggtacagcggaagcgagtagagtctctgtcttcagggaaattgtatccctcttcttgcacaggatgctgaaagaatttacttttaatcatctttattatctcattgaagcttggaattacatagctggaaaggatcttacaggttgtcactctgccacccaggctggagtacagtggcacaatcataactcactgccgccttgaccttcctgctcaagtgatcctcccatctcagcctcccaagtagttggaactacagatgactaccaccacgcctagcaaatttttgtatattttatagagactagggtctcgccatgttgcccaggctggtctcgaactcctggtctcaagagatctgccagcctcagcctgccagagtgctgggactacaggagggtgccaccatgcctggctggaaagaaatcttgagagatatttttcttctccagtgttgtcttgacatatattgaatatcagtggcatgcgtcattgtgtatgagtaaatgagtaggttaagaaaaattttcagctgggtgtggtggctcacgtctgtaatcccaccactttgggaagctgaggcaggtggatcatgaggtcaggagttcaagaccagcctggccaaggtggtgaaaccccatctttactaaaaatacaaaaattagctgggtgtggttgcaggcatctgta

SEQ ID NO: 56342 - DNA, 592 bp, Homo sapiens
cccaggtactcagggaaggggcaggagaaccacttgagccaaggagttcaaggctgcagtgagctgtgatcacaccactgcattccagccaggacaacagagtgacatcctgtctcaaaaataaataaattttttaatgatgaaactaactaaggtactgaggaggtaagatatttccccacggtaagtcattcagaaactaaatgtgaaaaaccaaaagaagcctctggggttagtattcccagtctccttgtctgcccaggaccccacatttgtgtaagttgctaattgcacaagggtatcctactgaggctgtgaatagagtagaaatccaggctgggatgggcttatcaagccatggactgtggcaaggagctacgcccacctggagatgggatcccctcttggaatcggcacaaaggctccaggcttccctgccaaacgcggcgcctgtggagctgtgctggggctcagctcttgggtcggacagatgaacggtaaggcacattagcagtgttacctacggtatcctcctgcgtgtcacactggaactagagcttctcttggcatgatgttaaagaatacctgttta

SEQ ID NO: 56343 - DNA, 296 bp, Homo sapiens
gggaggactgcttgagcctaggaggcagaggttacaatgagccaagatcacagaactgcattaaagcatgggcaacgacagggcaagaccctgtctcaaaaaaaaaaagaaaaaaacaaagaaccagtatgatctcattttttttaaaagaatacatttgcatgaaaaaatataatcatatacgtaagtgctagctattactcttaagtgatggattatggaagattttcactttctttttattgtgtgtatttttgacattttctacagcaaacatatatttacttttgttaaaa

SEQ ID NO: 56344 - DNA, 3988 bp, Homo sapiens
ggatccgcgggacagatgaggaaggggcttaagtcactgcagccagagggatggaggtggactgatgggagggcttctccggtggggttagaagggaaaagtagggaaagagaagtgtaaggtagatggcagaggcagagacatggaaagacagactctagggttcctgatgatatctatctcggccaacacaaaagggagggtacagtggtgggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagactatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagtgtggctaggttctgcctgcctatgggaagagggggccagggtgtgtggagcaagatggtgcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaaaaaagtg

SEQ ID NO: 56345 - DNA, 911 bp, Homo sapiens
ctggtctgtccgcggtatttggatatgtcgaccgcgccgacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaaaaaagtg

SEQ ID NO: 56346 - DNA, 3878 bp, Homo sapiens
ggatccgcgggacagatgaggaaggggcttaagtcactgcagccagagggatggaggtggactgatgggagggcttctccggtggggttagaagggaaaagtagggaaagagaagtgtaaggtagatggcagaggcagagacatggaaagacagactctagggttcctgatgatatctatctcggccaacacaaaagggagggtacagtggtgggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagactatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagtgtggctaggttctgcctgcctatgggaagagggggccagggtgtgtggagcaagatggtgcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcagagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaaaaaagtg

SEQ ID NO: 56347 - DNA, 2090 bp, Homo sapiens
ggatccgcgggacagatgaggaaggggcttaagtcactgcagccagagggatggaggtggactgatgggagggcttctccggtggggttagaagggaaaagtagggaaagagaagtgtaaggtagatggcagaggcagagacatggaaagacagactctagggttcctgatgatatctatctcggccaacacaaaagggagggtacagtggtgggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagactatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagtgtggctaggttctgcctgcctatgggaagagggggccagggtgtgtggagcaagatggtgcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtgagggaaggccatgccc

SEQ ID NO: 56348 - DNA, 171 bp, Homo sapiens
ggaggacaggggtgacagtaggatggggacagagctcagaaacctccctgtccttcctcagagtacagccgattcgaggccaagatccacgaccttcgggaacagctcatgaacagcagcctgggctcagggactgcgtccctgcggagcaaccccaaaaggggtttctac

SEQ ID NO: 56349 - DNA, 472 bp, Homo sapiens
aaggacattcaggcgcacaagttcattgaggccggccagtacaacagccacctctatgggaccagcgtccagtccgtgcgagaggtggcagagcaggtaggacctggcgggcacccggtcctcttccttctcccctctccccaccccactgcctccctccagctttctctaactctctctctctctgtctctttccctgctgggtctccactccgctcctccacctccttctcctcttgggcaactctgtctgactgcctgctctctgcccctgctctctctcccacctccctcacttcctgaccccaaattccccaccaccatctggcctctttctctccccactcccttctccttgccccatttctcctctcttcccatggccttgtctttggtggcttggccttcccactgggtccctccctttttcctgactccccgctggccctctcccctgcctcacccttttctg

SEQ ID NO: 56350 - DNA, 393 bp, Homo sapiens
  misc_feature (384)..(384): n is a, c, g, or t
gcaaactttctcacttcctcaaagaagagtagtgcactaaaaagaaggttgcacccggagagcatgtaaagtgtctcaagggggacatctgaagtgccccgttcccagggagcccactggctcctcacaagtaatctaatgaaagctatgcattctctctgggctcctcatatgaaaaaacccaatgtatgaagcaaagcctagaaaggattcaatactggagaaatgcacacagctaccgataaagacagctcaaaagtcctaaggctgctgacatgaaccagataattggtggctacagttgtgcctgctaagatttgggtgcatggggcttcgctttggttagctcccatggtcttctttttccaaaaaaaaaaaagaagncttcaggtt

SEQ ID NO: 56351 - DNA, 1509 bp, Homo sapiens
gggttttacaccaagacatgctgttcccaggggcatgcaggagacagaggccttcctcatctcaaccacaagaggccttcctcttttactaatccccctcagcacagaccctttgcgggtgtcgggctgggggatggtcaggtctttcccttcccgggaggccatatctcaggctgtctcagtggggggaaaccttggacaatacccaggctttcttgggcagaggtccctgcggctttccacagtgcattttgcccctggttaattgagaatggagaatggcgatgacttttaccaagcatactgcctgtaaacatactgttaatgaggcacgtcctgcacagtcctagatcccttaaaccttgattccatacagcacatgtttctgtaagcacagggttggggctaaagttacagattaacagcatctcaaggcaaagcaattttcttagaacagatcaaaatggaatttctcatgtcttcctttctacatagacacagtaacagtctgatctctcttttccctacagagactaatgttctggaaaatatattctgcttcctagtgcaggcaatagattatttgggcttccatttctttcctttctttccccatattagaaatttaagctgaaccatatgaaatcactatttcgaagaacagaatggtcaaatattgacaatttcctatggttcaacctaataacttagggacagccttgtggtaccctacccagtcatccttccacagccaaaagatcagctggagccctccattgccagagctgactgacctgggatggccaagccagaggaagacccacatcctggaagccctgtctctagtgcccaactccagttctcaagttgcaagggcccagcagacatgggggcactgcaggggtgaagctggcagttccttctcccagaaattctgagagagcctgggaaagtgccccaggagatggctgggctcacagctctacaagttacaggtctggcaatggccaccctctattcccagtcttccaacaaatcctgaaacttaagagagtggactcttacaataattatatttcacatgttaaaaaatatgactccgaaggaataagccagcactgctcatttagctagtttcacttaactagttgggaggaagtttagacaatgaaggtactgtactctcatcgttagatttctctggcaggcttgcagaactgctatggcacaccagacctccagccaagtgaaagaacctaactgaaagagtgccaaatgaccaggttttcttcatgttaagtatgcctgcctcccttcgtatccacttttttccctttacagtttcatttcttacactggtttgctcacatccaggttagatgctgcacaagatcaactaaggaaaaagctcagtcactgttaacatagggttccccatagccagtgagggaaaaatggcttccctgctttgcagcagactattcctagccttcaccatgccctggcact

SEQ ID NO: 56352 - DNA, 1745 bp, Homo sapiens
  misc_feature (1745)..(1745): n is a, c, g, or t
gggttttacaccaagacatgctgttcccaggggcatgcaggagacagaggccttcctcatctcaaccacaagaggccttcctcttttactaatccccctcagcacagaccctttgcgggtgtcgggctgggggatggtcaggtctttcccttcccgggaggccatatctcaggctgtctcagtggggggaaaccttggacaatacccaggctttcttgggcagaggtccctgcggctttccacagtgcattttgcccctggttaattgagaatggagaatggcgatgacttttaccaagcatactgcctgtaaacatactgttaatgaggcacgtcctgcacagtcctagatcccttaaaccttgattccatacagcacatgtttctgtaagcacagggttggggctaaagttacagattaacagcatctcaaggcaaagcaattttcttagaacagatcaaaatggaatttctcatgtcttcctttctacatagacacagtaacagtctgatctctcttttccctacagagactaatgttctggaaaatatattctgcttcctagtgcaggcaatagattatttgggcttccatttctttcctttctttccccatattagaaatttaagctgaaccatatgaaatcactatttcgaagaacagaatggtcaaatattgacaatttcctatggttcaacctaataacttagggacagccttgtggtaccctacccagtcatccttccacagccaaaagatcagctggagccctccattgccagagctgactgacctgggatggccaagccagaggaagacccacatcctggaagccctgtctctagtgcccaactccagttctcaagttgcaagggcccagcagacatgggggcactgcaggggtgaagctggcagttccttctcccagaaattctgagagagcctgggaaagtgccccaggagatggctgggctcacagctctacaagttacaggtctggcaatggccaccctctattcccagtcttccaacaaatcctgaaacttaagagagtggactcttacaataattatatttcacatgttaaaaaatatgactccgaaggatcccttgaaaccaggagttcaagaccagcccggtcaacatggcaagaccccatttctacaaaagaagaattttgaaaattagccaggcatggtgacatgcgcctgtagttccagctacttgggaggctgaagtggaaggattgcttgagcccaggagttcatggttgcagtgagctatgaacatgccactgcactccaacctgggcaacagagcaagaccctgtctcaaaaatgaagaagaagaagaagaagaggaagaggaagaggaagaggaagaaaaaaacaaaaaaaaaaaaacaagacacaatagaacgagaagcgagaccgcaaggccgaacggggcgcagacggccagaagcgactcacgcgaccgcacggagaagccgggcggacatacccgaatgagaccgcaaacacaacgggagcaccacacacgcgaacccccgccaagcacgcgaagaggaagagcaagatagacacacgagaggaacacagaacaccatacagccaagtggcacgctatatccgcgacgagaggaggagggcaaaccagcagaaacggaggcgcgacgcagagcagaagcagagaagacaacgggaagacaaaggcgcaccaacagaagcaccacatatgacgn

SEQ ID NO: 56353 - DNA, 754 bp, Homo sapiens
aatttagccgtcttgctaattccctaacttctgaccataaattcatatgtatttttgttaaacatattagattttacagactgtgtctgtcttgcaggtgatggggcaggtacagggaaaacttttttgataatcttcagaggttgactgtgaaacactcttgactataaggaggttttgaaagctgtttggaaaaatatcataccatacttattaaatgggggagaggggaaagcaacagaagtgctgagctcttcaacagtcaatatagcatttactgtttcctatatttaatagcattcagaacaatagaaacaagttggcacatagccaacttcaggtacctaactgaagataaatgttccctagaaactgaatagtttaaagccttcctgagaaaggaaactccttttattaactattttatgtgaactaaattccacataaactcctgcttaattttttaaaatagtcaattcctagaccatttctcatcttccttaatgatccaagaagatggccaggcatggtggctcacgcctgtaatcccaaagtgctgagattacaggcgtgagccaccacacccggccacagtaattctaatctttctaccctagttataagctcaacttggtaaataaaatattttaggtagattttatcatagattaaaggttaggaaaattttcgcaacctactcatctgacaaagggctaatatccagaatctacaatgaactcaaacaaatttacaa

SEQ ID NO: 56354 - DNA, 294 bp, Homo sapiens
  misc_feature (49)..(49): n is a, c, g, or t
ctaaacgaagatgattaccccaaagacacattttgaatatcctggtcanatctttggatctgtaaaatataccttttagtatggcacctgttaaaatgcaaatcaaatccctcaggaagatttgcatccccagttcgtttgcttccaatttcaaatcatattctgtggattacattgctgggatatggggtacttgccttgctgttagcagtctggaaatgctagttttctgatttctgccttaagaagattgaagccatttcatagaaaattatcaaaatataaggaaagtgt

SEQ ID NO: 56355 - DNA, 532 bp, Homo sapiens
gcatatcttaggcctcctaactgctgaatcttcagtaactttataaaaaataatttaggaaagaaatttttttacattttacacttttctaccagtcagtattctttattgcaaaccacataatcctcactgaccagtataacagcaaaaggaacatgttaaagttatctctgactttgctaacagacatcagcaagacaagagctggctttggagttgtctaatcagtaatgttgtgcgagcacattccaggagcttgatccactgcatgcagcacttactatgcacgaatctgaacaccactctcatccccaaggaacctgattagtcttccaacaaatcaaatccctcaggaagatttgcatccccagttcgtttgcttccaatttcaaatcatattctgtggattacattgctgggatatggggtacttgccttgctgttagcagtctggaaatgctagttttctgatttctgccttaagaagattgaagccatttcatagaaaattatcaaaatataaggaaagtgt

SEQ ID NO: 56356 - DNA, 400 bp, Homo sapiens
atttttggttacttcaggcaggagggtagacatagcacttatctggattggatgtagccacaggattagaattgttgggtcataaaatatgtacatgttcagctttagtagatcttgcctagagttttaaaaaattaaaaattaaaatattttttaaattacaataaattcagctaattttaattttagataatttttataatgtagttgatcttggttttaaccagagcatgttgctggattttactccccagtcgaacacagtagagagagaaggtggcgggttcttagtgataccatgcacttttttttagaacttcagtgctgtatcccttcatttacaatgtatgatgaaaaatactaaagaagggatggtggtggtggtgaggaggcaggagag

SEQ ID NO: 56357 - DNA, 422 bp, Homo sapiens
cagtgatgagcaaatatttttccacagatttcacacattttgtcaggtgttgatttagttctttaaaatgatgtgagcaaagtgctttccatttttccgtattaaatatttaaaatcctgcagtttgtgaataggaaagttaagagtataggcaccctatcttttgcccttgatatgtatatatttttctctttatggatataaagctaatgtaggttgctaatcagtaaccagccagttctcatgaacagtgaaatcttcaatcccacatactaagatctataatacacctgattttaaaatgcaattctttgttttctttttatttgcaaatatggaatgaaggtcattggaacatttctgcagcagactcagtgtggagccgtcagccagcagcacttagtctctgggtacggaaaagg

SEQ ID NO: 56358 - DNA, 319 bp, Homo sapiens
gagcaatcccatctcccttgttcccgtgctcagtgtcactgcctcctcttactgctgttcctgggctagtttccagtgctctcttatcccacttttccatctgtcacttgttccttctgtacctctcaactgcagcttgaaaagactagccttttgtaagcttcactgggcaattagagttcctttccttccatggggcagacgggacagctactggaaaccagccagctacaatggtacaggatagccttagtgtcttcagtgctcagctgtgttgggtagggctgctgctttttgtctcaagctgttctttttactc

SEQ ID NO: 56359 - DNA, 337 bp, Homo sapiens
attccaatctcacataatacacaaaaaacaatttcaggtggaatttatgttcaccaaaagacacttacaaaatgtgaacacttgtcaacaatccaaaagaagagcttacaatgcataaaattaacagagcatgtatccaaaatagctaaagaataattcttatgatcagtagttcattattgatcaattctttgactctatcaataaaaggaagactcttttgaagttttaaagaatacttttgtagtattccacacatcacattgcaacagtcttatgagtatcagttggctctcagagtgacagaaactggaacagaaggatattatttgataat

SEQ ID NO: 56360 - DNA, 485 bp, Homo sapiens
ttagaaattcttattccatgggaaacttagttgttaatatcttattaaaacccatccttaatttaaagggactgtttgatgccctaataagaatgtggtggagaagatatgaatggataagccctgtttgaaggctgccagcatcatttgggaggactgtttgccctcccctctctcctagcaagtgtgttttaaggccaactggtggcatttctgtgtgactagggagactccctggactgaaaatatgaatataatgaacaggtggactgcagacctgtctccacaaagcatgggttgtccttttcccaccacattttagtagaaaagaaatgtatttgaatttttttctatgaacaatctatcttactgtacagtaccaagtgtgatgtattttctctcaaaggatgattaagttatgagaatgtagattaatatatgtttttaattttatattacttggaatacaagtatgtggagaacca

SEQ ID NO: 56361 - DNA, 997 bp, Homo sapiens
gccggcagaattcccagggctttgaaaagtcccaagcacccagcagggctggcagttctgagcgctggcaaggctaagtgggtcagaggagaccctcgccaagccggtgactcactcactcgctcaccctctctcactcttgatgggccaagtacctgccatgtgctacggacacagcagagcgaaaggagacgctgccctccgggaatttgcagccgcttgcagaggcggccccttagcagctgcgcatccgggtggatagcggcgcttctgcccgcccagtgcctacccgcctctccgagagaaaaacagcccctggttttctctctgcaattccccttctccactctctcccttctactcagtcctggtgccgcagacccctcctcctggttcccagagatcctggccagcccggtctcaggcaaggccatgtagaatgccgggagtgataattgcgtattgtttcatgactgcaagcctgtgtccaggtggctccttctcctggaacgcccttcccaccacacctgcggccgcactgctccgtgccctgctaagcctcacttcttttgaggcgaccctctcgctaagtcccgaccacctggccctctctctgctcagtgcctgaacacatcaggcttgctgcagcccctgcctttacctctctacttgtagtgttctttcagagcctgctcccatatggtatcacatatcagatatctgatgcagagccttagagaggctgttccaggtcacacaaactaaggaagtccctcagccactccctgccacatcaccctgttctatttccttcacagcacttaactgtatatctgatatttccttgtttctttgtttgttcattgtctgtctctcccactagactgtaagctctttgaggacaggaaatttgtgagatgtattcactgttgtatccccaatacacagtgatggcttgtagcagttgctaaataaatgtttgttgaatggcttaatg

SEQ ID NO: 56362 - DNA, 945 bp, Homo sapiens
gccggcagaattcccagggctttgaaaagtcccaagcacccagcagggctggcagttctgagcgctggcaaggctaagtgggtcagaggagaccctcgccaagccggtgactcactcactcgctcaccctctctcactcttgatgggccaagtacctgccatgtgctacggacacagcagagcgaaaggagacgctgccctccgggaatttgcagccgcttgcagaggcggccccttagcagctgcgcatccgggtggatagcggcgcttctgcccgcccagtgcctacccgcctctccgagagaaaaacagcccctggttttctctctgcaattccctggttcccagagatcctggccagcccggtctcaggcaaggccatgtagaatgccgggagtgataattgcgtattgtttcatgactgcaagcctgtgtccaggtggctccttctcctggaacgcccttcccaccacacctgcggccgcactgctccgtgccctgctaagcctcacttcttttgaggcgaccctctcgctaagtcccgaccacctggccctctctctgctcagtgcctgaacacatcaggcttgctgcagcccctgcctttacctctctacttgtagtgttctttcagagcctgctcccatatggtatcacatatcagatatctgatgcagagccttagagaggctgttccaggtcacacaaactaaggaagtccctcagccactccctgccacatcaccctgttctatttccttcacagcacttaactgtatatctgatatttccttgtttctttgtttgttcattgtctgtctctcccactagactgtaagctctttgaggacaggaaatttgtgagatgtattcactgttgtatccccaatacacagtgatggcttgtagcagttgctaaataaatgtttgttgaatggcttaatg

SEQ ID NO: 56363 - DNA, 1105 bp, Homo sapiens
gccggcagaattcccagggctttgaaaagtcccaagcacccagcagggctggcagttctgagcgctggcaaggctaagtgggtcagaggagaccctcgccaagccggtgactcactcactcgctcaccctctctcactcttgatgggccaagtacctgccatgtgctacggacacagcagagcgaaaggagacgctgccctccgggaatttgcagccgcttgcagaggcggccccttagcagctgcgcatccgggtggatagcggcgcttctgcccgcccagtgcctacccgcctctccgagagaaaaacagcccctggttttctctctgcaattccccttctccactctctcccttctactcagtcctggtgccgcagacccctcctagcctcaattgctccaaagaactccggacccgtaccccgagcccggcgtcccagcggcgaagttgatgggccccgcaggagcccttgcggtgagaaccgagtcctggagcccctggagcccccggagcccccggagctgcagccggggcagcctcctttccgccgggagtgataattgcgtattgtttcatgactgcaagcctgtgtccaggtggctccttctcctggaacgcccttcccaccacacctgcggccgcactgctccgtgccctgctaagcctcacttcttttgaggcgaccctctcgctaagtcccgaccacctggccctctctctgctcagtgcctgaacacatcaggcttgctgcagcccctgcctttacctctctacttgtagtgttctttcagagcctgctcccatatggtatcacatatcagatatctgatgcagagccttagagaggctgttccaggtcacacaaactaaggaagtccctcagccactccctgccacatcaccctgttctatttccttcacagcacttaactgtatatctgatatttccttgtttctttgtttgttcattgtctgtctctcccactagactgtaagctctttgaggacaggaaatttgtgagatgtattcactgttgtatccccaatacacagtgatggcttgtagcagttgctaaataaatgtttgttgaatggcttaatg

SEQ ID NO: 56364 - DNA, 335 bp, Homo sapiens
accaatgcagtccttcataggagtgggcgtgtgctttcaggggcaggcacttgatattttcttgtaccagggcagcactccagagtgatagatgaaggtaccaactgtggatgggctaaaacatagcactctgtattcaaacctcctgaggacttcatgaggcctcagaggttccaaaaccactttttgaaaaacattgcatgtttccgtagtttatttagtggagtagagaactacacaattgttttaatgacaaaggatgatgttgggtgtggattgatggaaagaccagacagagataccatttgggtaaaaattaaataatttgcttatct

SEQ ID NO: 56365 - DNA, 338 bp, Homo sapiens
gtttaagaatggggttgacatttctaagtcttatgtcccccagaaagtctttgtgaaggatgaggctgcctcctcctgtgcctgggagtggggggacttgtgaacctgcccctcaccagcacctgtccctacccccctcacccacacctgcctcccacccacacctgccccatgccttcccgcttacccacacctgcccctcagccgcacctgcccccatgcctgcctgctcacctgcacctgcccctcacccacacctgcacgctcacacctgcctgttcacctgcacctgcctcccacccacacctgcccctcacccgcacctgccccatgcctgc

SEQ ID NO: 56366 - DNA, 411 bp, Homo sapiens
aggcctttagcaaatttaagctagcagttttgctgatttttatattaccagtgttcactgttgtcactggccatacttgttaattttttatttcttggccaaaaccaaagaaaatatttatcattctactgtagtatagtcataccacttttagattagaatgttaaaccaaatgtagcaaagattggggactgcaaggcataaaataatgtttaggaactgcaacattaaaagataagtttactattaagcaatcagatttagatcaatctggaaatagctatcctcaatttaagatgttctaggccgggcgcggtggctcacgcctgtaatcccagcactttgggagattgaggtgggtggatcacaaggtcaagagttcaagaccagcttggccagtatggtgaaacc

SEQ ID NO: 56367 - DNA, 428 bp, Homo sapiens
tgacaacaggaggagtggcacccagctaaatctacactgtgagatattcaacaacattagtacccaaggaggagatcttggagggcttgttaaacagaaatgtcttgggccctactcccaaagtttgtgattctgtgggacaatatttgcatttctggcaagttcccaggagatactaatgccactgatccaggggccacactttgaaaaccactggtcgataggataaacaacctgcttatccaaccaatcagtgacgtgagagggagtggggatattatagaataaaatgccttctaacagcctacaaacttaagacaatgtatagacttcacctggatcttaattcaaggcagctgcaaaaagaaatgttgaagcaactgggaactaaatgtagacaaagtgtggagttaaattaagaaattatc

SEQ ID NO: 56368 - DNA, 733 bp, Homo sapiens
gttgccaacattcgtaaggtccattcctgatggctctgaaaagggagatttcattgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 56369 - DNA, 2074 bp, Homo sapiens
cactctggctgggagcagaaggcagcctcggtctctgggcggcggcggcggccctctctgccctggccgcgctgtgtggtgaccgcaggcccgagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgttgagcaagtgtgctgctccttcgaatgccagcctgcaagaggacctccgggcctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggaccaaagggctacaagggagagaagggcaagcgtggcatcgacggggtggacggcgtgaagggggagatggggtacccaggcctgccaggctgcaagggctcgccgggttttgacggcattcaaggaccccctggccccaagggagaccccggcgcctttggactgaaaggagaaaagggcgagcctggagctgacggggaggccgggagaccaggagctcggggaccatctggagacgaggggccagccggagagcctgggccccccggagagaaaggagaggcgggcgacgaggggaacccaggacctgacggtgcccccggggagcggggtggccctggagagagaggaccacgggggaccccaggcccgcggggaccaagaggagaccctggtgaagctggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 56370 - DNA, 4161 bp, Homo sapiens
  misc_feature (2783)..(2784): n is a, c, g, or t
  misc_feature (2786)..(2786): n is a, c, g, or t
  misc_feature (2788)..(2789): n is a, c, g, or t
  misc_feature (2795)..(2795): n is a, c, g, or t
  misc_feature (2797)..(2797): n is a, c, g, or t
  misc_feature (2799)..(2799): n is a, c, g, or t
  misc_feature (2802)..(2802): n is a, c, g, or t
  misc_feature (2805)..(2805): n is a, c, g, or t
  misc_feature (2807)..(2807): n is a, c, g, or t
  misc_feature (3353)..(3353): n is a, c, g, or t
cactctggctgggagcagaaggcagcctcggtctctgggcggcggcggcggccctctctgccctggccgcgctgtgtggtgaccgcaggcccgagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgttgagcaagtgtgctgctccttcgaatgccagcctgcaagaggacctccgggcctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggaccaaagggctacaagggagagaagggcaagcgtggcatcgacggggtggacggcgtgaagggggagatggggtacccaggcctgccaggctgcaagggctcgccgggttttgacggcattcaaggaccccctggccccaagggagaccccggcgcctttggactgaaaggagaaaagggcgagcctggagctgacggggaggccgggagaccaggagctcggggaccatctggagacgaggggccagccggagagcctgggccccccggagagaaaggagaggcgggcgacgaggggaacccaggacctgacggtgcccccggggagcggggtggccctggagagagaggaccacgggggaccccaggcccgcggggaccaagaggagaccctggtgaagctggcccgcagggtgatcagggaagagaagggcccgttggtgtccctggagacccgggcgaggctggccctatcggacctaaaggctaccgaggcgatgagggtcccccagggtccgagggtgccagaggagccccaggacctgccggaccccctggagacccggggctgatgggagaaaggggagaagacggccccgctggaaatggcaccgagggcttccccggcttccccgggtatcccgggaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagnncnanncggccntngncangcntngatccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagaaaagcttggaaagccaggacacaacgctgctgcctgctttgtgcagggtcctccggggctcagccctgagttggcatcacctgcgcagggccctctggggctcagcnctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 56371 - DNA, 373 bp, Homo sapiens
ccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgct

SEQ ID NO: 56372 - DNA, 439 bp, Homo sapiens
gccgacacggtccgagaagacgacagaaggatgctgtacttagtgctgttgcggtaaaggagtgaagagaagacgggattcagtgaatgttctggaaaatggctagagtgtacctagagagggaaaatttcaatagacagtaggccagttcaagactggatagaggccgggcgcggggcctgtaatcctagcactttgggaggtcgaggcgggtggatcacctgagctcaagagttcgagagcaacctgaccaacatggtgaaacaccgtctctactaaaaatacaaaaattagctaggtgtggtggtgggctcctgtaatcccaggtactcgggaggctgaggcaggagaatcgcttgaacccggaaggcgaaggttgcaatgagccgagatcatgccattgcactccagcctgggcgacttagcgaaactccgtctc

SEQ ID NO: 56373 - DNA, 2060 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56374 - DNA, 2319 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggtaactggcaagggctggttttcctttttatttttggacattggatgggacagatgacagtggagcacattggtcccctcggacccgtgactgccgtagtccctccatgtcacaactgctaaggaatttcttggacacatcccatcccatagacccctcagcagcaggtagagggtactctgtgctgagccctgaggggagtgaggatggagtgtggctacagccttcccgagaaccccagtgttttgtgcacccgcaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56375 - DNA, 2277 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggtgcttggcacaatgcatgaagagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56376 - DNA, 1839 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56377 - DNA, 1870 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatcttacacatcatcaccagtagatctgtaatacctcacac

SEQ ID NO: 56378 - DNA, 1486 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaaaaaccccccaatttggggttttaaacccccctctttttttg

SEQ ID NO: 56379 - DNA, 1221 bp, Homo sapiens
ggggggctgtgtgctgtgttaattgatattagagccccctccagatttgaactgggaccatttctccccatcccctacctgcacagggattgttaaacaagtctgggcctgtccttgtgtcccaggcaatgtaagcgttgtccccacctctcactccagcaggaagaaccggacccggcgaacctggaagtggaccatgatttcttccaggacaaggtgtggccccatttggccctgagggtcccagcttttgagactctgaaggtaactggcaagggctggttttcctttttatttttggacattggatgggacagatgacagtggagcacattggtcccctcggacccgtgactgccgtagtccctccatgtcacaactgctaaggaatttcttggacacatcccatcccatagacccctcagcagcaggtagagggtactctgtgctgagccctgaggggagtgaggatggagtgtggctacagccttcccgagaaccccagtgttttgtgcacccgcaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56380 - DNA, 1548 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggtgcttggcacaatgcatgaagagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggtgggtgcctggcacagcctcttagctgcttggcagccaaaggtgttgggtgactcctgcaccaggttaggaagcgagaaagtggagttgataagacagatccctgcggtctaggacctcagtgtgtcaggaagaaaatacacagacctgcaatgccctgggagtgctgtaccacagatatggacaaaacactgcgaggtgcttcctaatttgtcagatcatgaaaaccacctggaacacatcccagacctaataaaccagaatctctagggaaggagcccacaaatctgggtttttaacaagaaccttaagtcaggagttagcaaactttttctgtaaagggccagataggtatatattttaggttttgctggccatacagtctctattccaaccactttgctatcacagcatgaaagcagccatagacaaaagtgcaaatgaaggagtgtggctcatttatgaaaacaggcagcaggtcggatttggcaacccctgctctaagtgattctcatggtcaggtgagggtgggcatgtttgtgatgcaatatggccagaggctttatttgtatgtttatttaacaaacacccaagtctcacagtgacatcaattaatatcctaaatgctgtacagatatt

SEQ ID NO: 56381 - DNA, 936 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggtaagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctggaaaatggctagagtgtacctagagagggaaaatttcaatagacagtaggccagttcaagactggatagaggccgggcgcggggcctgtaatcctagcactttgggaggtcgaggcgggtggatcacctgagctcaagagttcgagagcaacctgaccaacatggtgaaacaccgtctctactaaaaatacaaaaattagctaggtgtggtggtgggctcctgtaatcccaggtactcgggaggctgaggcaggagaatcgcttgaacccggaaggcgaaggttgcaatgagccgagatcatgccattgcactccagcctgggcgacttagcgaaactccgtctc

SEQ ID NO: 56382 - DNA, 642 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggtaagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctgttttttgagacagagtcttgctctgtcacccaggctggagtgcaatggcac

SEQ ID NO: 56383 - DNA, 819 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggtaagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctggaaaatggctagagtgtacctagagagggaaaatttcaatagacagtaggccagttcaagactggatagaggccgggcgcttcggccttccaaagtgctgggattactggcgtgaaccaccgcacccagcctgtacttttagtcgagacagggtttcatcatgttggccaggctggtcttgaactcctggcctgaagtgatccgcccgggcccaactggtacggcggg

SEQ ID NO: 56384 - DNA, 581 bp, Homo sapiens
tgaggcttgcttgcagaggggacagcttttttcctgaagatggagactaaggggtgctacacgttgggagtctcggtactccacagccaagctgaaggaggaacacttccctcctgtgtcacgggaactgcccctgggccgtggtagttctctgtccttcatcaggctttgtctctgtggttcagttggttaagatgaccttccccggcttacaagccctagagaggggttggggggcacaggaaatacaatccaagagcagaagtcctcatccctctttgtgagttctctttttcttatcacagggatggaggacgaaggttggtttgacccctggtgtctgctccaggggcttcggcgaaaggtccagtccttgggagtccttttctgccagggagaggtgacacgtgagtctgagcttgtttcctctagcaaccggggcataggcctagactaggtcttatcttctcactcacaagctaagcaagggctggagggggaaaggggtctccctgagagcaggtcctaggcatcttgacctgggctcctcactgatctgcgttgtgacttgtgatctgctt

SEQ ID NO: 56385 - DNA, 1999 bp, Homo sapiens
tgctggtaccgcctccggaagtaacgcggatgtgacggctgcgataatagcgaggcagcagtgcagctttcagagggtccgggctcagaggggctatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56386 - DNA, 1898 bp, Homo sapiens
gcagaggaggcttttctctgcgcgtgcctggcctccgggtcaagaggccccggcccatgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56387 - DNA, 1808 bp, Homo sapiens
cagactgcggcgggaacaggatgggggctcctcttgaaacattggtggctacaggctctcatgatctctgatgcctggggcctcagcatcttccttggtagcctcttcctcttcatcctcctcttcttcttcctcttggggaggcccccggccagagccgggctcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56388 - DNA, 1637 bp, Homo sapiens
gatatccgggatgttggggtggttacccctcctttagcccagagtggggagcagcccagctagcaaggtagccagagagcaagaatgggtcagccaactaggagaggggggccctggccttcttcctagtggtggtgccgcaggtctggggcactgagcctggggagctgtgggggaagaaggcaggaaaactctttctggcatccttaagtcagtttctttcaggagcttctgtctgcacacaggagtacctggccgtagtcgatgctcctcccctggacctccggttcaacccctcgggctacctcttgctggcttcagaaaaggatgctgcagccatggagagcaacgtgaaagtgcagagggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 56389 - DNA, 937 bp, Homo sapiens
cgagggaaaaattcggctaggacaggctggtgttaccctgagggccgctggccaattggcgcgctcgtctgaatggcgtttggcgcggagcagtgacggctgcgataatagcgaggcagcagtgcagctttcagaggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatggatcggaggacgaaggtagacagacaccaggaggcaacggcaccaaggagacaacgggcgaagaggccagaccaagggaataccaacgtgcacagggagaaggggacacggtgagcaacccaacgtgctacaagaggaaggagaaccacgagaagcaccacagccgagagacggaaacaggaaaccagaaaagacacggcgaaaaaaggaacggaacaggaagtacaagacggggaaaggcgcaaatggcgaca

SEQ ID NO: 56390 - DNA, 1129 bp, Homo sapiens
cctgcctgacatctgggtagggggtttgtccctggaattctgggacactggctggggtttgaggagagaagccagtacctacctggctgcaggatgaagctggccagtggcttcttggttttgtggctcagccttgggggtggcctggctcagagcgacacgagccctgacacggaggagtcctattcagactggggccttcggcacctccggggaagctttgaatccgtcaatagctacttcgattcttttctggagctgctgggagggaagaatggagtctgtcagtacaggtgccgatatggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccactcgatctgctctgaccttaagcggagtctgggctttgtctccaaagtggaagcctgtgattccctggttgacactgtgttcaacaccgtgtggaccttgggctgccgcccctttatgaatagtcagcgggcagcttgcatctgtgcagaggaggagaaggaagagttatgaggaagaagtgattccttcctggttttgagtgacaccacagctgtcagccttcaagatgtcaagtcttcgagtcagcgtgactcattcgttcttccaacagtttggacaccacaaagcaggagaaagggaacatttttctacagctggaaagtgagtcctatcctttgaggaaatttgaaaaaagacatggagtggtttgaaagctactcttcatttaagactgctctccccaaccaagacacatttgcctggaaattcagttcttagcttaaagactaaaatgcaagcaaaccctgcaattcctggacctgatagttatattcatgagtgaaattgtggggagtccagccatttgggaggcaatgactttctgctggcccatgtttcagttgccagtaagcttctcacatttaataaagtgtactttttagaacatttggaaagagatgaa

SEQ ID NO: 56391 - DNA, 361 bp, Homo sapiens
cactcggtagccagtacctgagttataaatacagtgactcacagaaaataataaattttcattaggctggcctcccccaagttaaatctgtaacatgaaacagccattttaaagtggtgtctaggcagggcatggtggctcacacctgtaatcctaatactttgggaggctgagacaggcagatcacctgaagtcaggggttcaagatcagactggccaacatggtgaaaccctatctctactaaaaatacaaaaattagccggatgtggtggtgggcccctgtaatcccagctacctgggaggctgaggctgcagtgagcggagactgtgtcactgcacgccagcctaggtgacacagtg

SEQ ID NO: 56392 - DNA, 354 bp, Homo sapiens
ggcatggagtcccctggactcagtgctctggctgagggcctccaggatgaagataccctgtgcaaagcctcacacttttgctgttgctgggctcactgtgtgaaattccctcctccctccttccaccttccctatgctgaactgccactcctccatcctccatggccagctaagccaacacctccccacttcctcctgacaacccaggcacagccactgacctgtcccatggctgtcacagccctttcttgggctctcaatggtatcattgtcacctgtgtgctcatgagcctctgccactcaactccaagcacatcaaataaagagctcaaaacatatcggatactcaacaaa

SEQ ID NO: 56393 - DNA, 380 bp, Homo sapiens
agcagctttattcttaccttatattggttggtgtagtggtctggcttctacaacattcccttactgtgatatctaagactcttttcccctagagctgtaattctagggctggaagatctggttcatccaccttctagaagtctgacatctcagcccaggttatgatattatgagaatatttactctgtggctttcttagatactgttaaatactctgtaccagtgttcctctctcctagacaggaagatattctgttcccttgggggcatactgctagtttagtgtggtggttactggagaaaagctagccccagttgtattattatcctttttgcctcactctagttgtagttttcattattatcactatcgccaggtc

SEQ ID NO: 56394 - DNA, 674 bp, Homo sapiens
gtcacatccattagactgtgtagaaaaacagcctgtttcctggcaagagtgacaccatcttgaagcaaaactatcctggggactgatgtttgacccacagcataccgaggtgttctgcagcaaaggtctttaaacaatgctcataacatatataacccctcataaagatgcttatctaacgtccccagtgatcacaatagtctaagagctaactagttgcacttgtctttaccctagaggcttgctaaataaagcatactttctggagggcaagtgcaggggtcgcttctgtttgtctctactaagtatttctttctgagaaattcgattggtcagcctctttggtctcccagcttcctccatctttggaagcaggtttctgtaaattgacaaaaatgtaagcctttgataataagtcaaggatgtagtaaaatgacagttctctgcatttcttgtggaattgtaattattataactatttttgagaaaaattaagcaatatctggtaaaggtgaagatctaaatgttctgtaacccagtacattctggatataagtgtgtacctagattaatgcgtgctcatgtgaacaaaaaaaatatgtgtaagtatgctctttggagcatctttttgtaatagtaaaatattaaatgtaaatgaccaatgtcataaagtt

SEQ ID NO: 56395 - DNA, 1131 bp, Homo sapiens
tagtgtgtaattgaccatcagggataaatgggcttcaaaagtgttaattgtctccttacttacagtgagtttctagagatagccctgtctttcagaaattctctgacatctgcttgcgcaatgttataaccactttcccacactactcccctccagaaatctcattgatatgtggcgaggacacgccttagctatcaccccaatggatgcttctttcattgacccaaatccagaatgtaatggggaactgaatacaagttggatgtctccacccttggaaagcacatcttttgttcttactgaagtagtttaacaccaccagatgatcaagggatcagggtatctttctggtatctttttaatcactgaaggactttgacagcagtaatggtggcattgttgactcttaaatttctgaacgtttcacttaatggcaagtgaagagatatagaatcccccaaagagtgtcaagatgctaacttccaaccctatttttatgtactgaagaggcctcagtgtctcactgaactctaacctttttgtcagtgttcctcaacactggatgcgtattattacataacctgaggagttaaaaaatacaataaccagatgtccaattaaataaaattagaatctggaggaggtagaactcaagcatttacagttttgttttgttttttttttaagacagagtctcgctctgtccccaagtgcagtggcacaatctcggctcactgcaagctccgcttcgtgggttcacgccattctcctgcctcagtctcccgagtagctgggactacaggcgcccgccactacgcccggctaatttttttgtactttttagtagagacagggtttcactgtgttatacaggatggtctcgatctcccgacctcatgatccgcccgcctcggcctctcagagtgctgggattacaggcgtgaggccaccacgcccggcaagcatttacagttttaaatctcccagtcagaataaattcttattgagggccatacctagcctgtcttcatcaaactcatagggtgaatctttgtcaaacctataggagagagatgcaggccatagagatggtcttgctgaagggcttatagctaaattaggtcagatcca

SEQ ID NO: 56396 - DNA, 424 bp, Homo sapiens
ttaaggttcttttatcatcagatatgacacaaagggaaacatcaaaatgcaccgtaaagttaaatcctagttacctttttttgaagctgttggcaaggtttgaccacttggggcatcttctgctgtgagatgacacttgaaaaacacccatcaaagttttcctggtaggaatctctctttactgcgtgtttttttgaaaagctgacagagaatatgctttggctttgacactaatgaagccaccacgcccggcaagcatttacagttttaaatctcccagtcagaataaattcttattgagggccatacctagcctgtcttcatcaaactcatagggtgaatctttgtcaaacctataggagagagatgcaggccatagagatggtcttgctgaagggcttatagctaaattaggtcagatcca

SEQ ID NO: 56397 - DNA, 508 bp, Homo sapiens
gaggcaccagggcacggcggacgctcaccccgtgaccacgatggtgaccctgactgcgggaagaagaaccggacccggggcacagcggggctgcgtgaggatccacaagaactatgctttggcgtttcacccctgttgttacttgtgactcagtttcttcagcctggtggggtgttccctggtgtttcccagtgttctgtgactgtcctgtgaaggccatagggatgggctcaggagggggctccctgaagccagtggacactgccagagtccactgtcctggcaaaaggcagaccctggggccctcgggaaggagggaggtggcagcgggggcagcagcgggagggggagcagatgacgtgccttgccaggaaccccaggaggagggggcctgggacctgtggcctgtggtggctgtttacagtttctctctgtattgtggtttccttctcttcaatagtttcagtatatgtttctcttcaataaatttcattccgtgttccagccg

SEQ ID NO: 56398 - DNA, 1044 bp, Homo sapiens
aaaaaaaattcttctctacccatttgggcttaagacaattcccagaaagtgttttcattatttaaaaaataataatagtaaatgaaagcaattttagaggtggaaaataccttagaatggaatcatttgcattatttgacaaatgagagaagtgacatgacttgcctaaggtcatcctgcaaagttagtggcagagttaggacttgaattccagtcttctaattccttggtcagggcaatttctactgtgttatgctgtctgttagaaataatgacttatggacactttgtctttaagttgtattattgtaaatacccttaaactggccaatagattttagaaaggcaggcatgggagtagatgctgagaattctagccataagaagaaaagtattttaaatcttacagaaatgtttaaacaacccaaaatacatgaataaaaatgacatttctttgtaggacctgccaactaactattcacacacatttatagaggttataaggatcttggctctagaacaaatttttgaaattagatcattttaccatggatgttaacaaaattggaaattttttgtcactgagaaaattatcacaaagcacagtaaatacatatacttaccatacattttgtaaaaaacacattttttaaagaaaatagggatgggtatggtggctcacgtctgtaatcccagcactttgggaggccaaggtgggaggttcacttgagcccaggagttccagaccagtctgggcaacatggcgaaaccccatctctaccaaaaatacaaaaattagatgggcatgttggtacacgcctgtagtcctagctactcaggaggctgaggtgggaggatggtttgagcctgggaggcagaggctgcagtgagccaagattgcactattgcactccaccctgggcaatagagccagatcctgtctcaaaaaataaaaatagactgggcatggtggctcatgcctgtaatcccagcactttgggaggctgaggtgggtggatcacttgaggtcaggagtttgagaac

SEQ ID NO: 56399 - DNA, 337 bp, Homo sapiens
gaagaaaaaaaatactgttatggaacattcatgaattcttcaaaaatgtttattctaggtctattaataagcgatgctgtgttaggaaatagaagcagttgctacagagcttgagtcctaaatgccattttcacatactgaaatgttaaagtattcttacaggattttgctgtcaagattatgctggccttaaaaaataagctgactatcattgtctgctctctggaagtatttggaatacaagaaaagacagacgtgatgcattttaaattttgccggaccagcactatcaatggaatgtgagatgtcttggcaagtatctgtattgccaggtgta

SEQ ID NO: 56400 - DNA, 1502 bp, Homo sapiens
gccccagctatttctggggtcctcaaacgaaacctcccatggccaagtcatacccaacacgggcctgctcccctgttctggcctcagctcggagatgctgagtgacagaggctcagccttcgggtgttcctggcaaaccctcacctccggaggccccacagctcagacctagtccttggttcacatggccccacttccatcctctttttcccttaagactgatttgtcctgggagatcactggatccctcattcaggtggagtgctgcaggacgacactttttccaggggtgacccaggcctgcagggtcccagtgtcacaggcaggccttgcccgagcctccacctgagcccctgctcctcttctcccacagggaggtggaggttacagtgaggtgagttcaggccactgcacttcagcctgggcaacagagtgagattttgtatcgaaaaaaaaaaaaaaaaaaaaacagggtgcaggcagtggaggcaaattagggcatggacgaagctgcctcagtgccacctttctgcccggcactcagatgccattccactaggcccacgaggcctccaaggaaagccatgttcatggccgagaccaagggggttgccctcaaccagctgtcactacgggagctgcagaccatcaggtgcggcccacccccttccccacgctgtctccaggtggcctggcaccctggcccacctcttcctctctttagccccctgttctcaggcgacatgagccgcatgtgggaatacgggcacagcgtggagcagtacagtgccctggatggcactgagcactccagcgtcgactggcagatctgccaggtgcgggcgctactacaggcacagcaggcctaggtcctcccacgcctgcccccaaataaagtgggcgcgagaggaggctgctacgtgtttcctgccccaccctggctcccttgttgctgggctttccagggctggccagtggggacggtcagggactggagaggcagagcggggtcgcctgtaatcgcagcactttggaaaggcaaggtgcgaggatgcttgagaccaggagtttgacaccagcctgggtaacacagggagaccccatctctacccagtaataaaataactagcccagcatggtggcccatgcatatggtctcagctgcttgtaaggctgaggtgagaggatcatttgcgcctaggaattgagactgcggtgagctatgatcacacccctgcattccagcctggacaacagagtgagaccctgtctctaaaaataaaaaataaaatggaagtggagaaaactgggcaaggacactgagagtcatagatgggaagggaagagggggctcctatcacagcctctgccctgtccaggccctgtccccttcaaacagggtatcacagtgacctcctaggccaggagcggcagctcatgcctgtaatcctagcactttgggaggcctgggcacaaagcaagaccccagctactgcattaaa

SEQ ID NO: 56401 - DNA, 775 bp, Homo sapiens
ggaaagaggtttaattgactcacaattccacatggctgtaggtcagggcagtggggttcacaatcatggaggaaggcaaggatgagcgaagtcatgtcttacacggtggcaggcaagagagcatgtgcaggggaactgccctctataaaatcatcagatcttgtgacatatattcactaccacgagaacagcttgggaaagatgcacacccgtgattcgattacctccctccaggtccctctcatatcacacgggaattatgggagctacaattcaagatgagatttgggtggggatacagccaaaccatatcattcatcatctgagggaactgtggtctcagacagctgggcactgagagtgcacgctgccccctagaattccacacctacatcacagagagacagaacagtctcaaaggattcttaaggttaatgtggggagccaaaggaggagatgaattcacagcttgtgccttaccttctggtctaactaaaactacttttgtcctggcccaacaagattcccagactcttttctgggttgcaccaggggtaattcagaaagacaaaaagttattaatgcccctccattccccacagctcctgaggtctaagttgttcattccctgggttttaggttgttgttctccctctgcttccacagaatcagtgtgccccattccagtacctatgatttcacctgtattcttgtcacctcctactttctcctagacattttatctaacagagccaggtgaaacagagacaaggat

SEQ ID NO: 56402 - DNA, 232 bp, Homo sapiens
ccaagcttggtaccgagctcggatccactagtaaaaaaccgccactcgtgctggaattcggcttaccttctggtctaactaaaactacttttgtcctggcccaacaagattcccagactcttttctgggttgcaccaggggtaattcagaaagacaaaaagttattaatgcccctccattccccacagctcctgaggtctaagttgttcattgaaccagtcagcattaacca

SEQ ID NO: 56403 - DNA, 301 bp, Homo sapiens
gctccactttacccaatcaagtattttttcttccacattcaccatataaaattcttcccccaccctccctaagcctctctgttggaactctgagctgcttgcagtctggagctgcctagtttatacatttctgaatgctcaaatatattttctaatgtttcaaagtggctctggtgtaggaggttgttggtggagtgacctgagagtgtacaggaatcgaggccatatgagatctctggactctgcactccattttgctgtgcactcaaaactactctaaaataataatatatctttaaaa

SEQ ID NO: 56404 - DNA, 130 bp, Homo sapiens
tcaataaaacagaaatctgatttctgcaaagtaggccaccttacggtagaaatacatgattaggccccaccaaaaactttgattaggctattatcttctggatcctggatcccctccaaccaaaccaaac

SEQ ID NO: 56405 - DNA, 450 bp, Homo sapiens
gagagagagaaaatgagaattgaactaattaggatgttgagtcttcctgtgtaagagcagcaggaggaaataaagaacagctatgccttttcattttcagtcctgtgctcttctggagtgtgttaaatataaatcttgatttttttaactttatttccagatagtttatcttttttgttggaatcctttcctccactatattttgtaactggttattatttatatataagaaggcttttgatattttaaataattttatatctcattaaattatcttactatttaaaatagtttttcagttctaaatcacaatgagataccacttcacacccagtaggaaggctgtaataaaaaagacgacaatacaagcattggcaaggattggaaccctcattcattgccagtggggatgtaaaatgtgtggcctctttggaaaacagtttggcaatt

SEQ ID NO: 56406 - DNA, 147 bp, Homo sapiens
aaagggtgcagagcgtcagagttccagaagtggctttaaaccaccaaaaggtgcctgttgctggcttttgagcctcggttcacaagtcaggatgtggcctctttgatcctgcacatactgttctgccaacctgacccggctgacatt

SEQ ID NO: 56407 - DNA, 317 bp, Homo sapiens
aaaatgttttattgatattaactcttagattggatatagataaagccataaaacttgacctttcctaatagattacaaaaggtttttgtgtcatattgaaatactcattgcaaacaatcggattggacactaaaccaatgtaatttagttaagaccatataaactcaaacgcttttttttcctttttaatttcctttttttctagtatagtctgaagggaactcaagtacttttcaagctagggttctgttctcagttccagtgtctaagaaacttaaaagtaaattattttttaaggataaaaaggaatagacata

SEQ ID NO: 56408 - DNA, 365 bp, Homo sapiens
ccacctcaagagcaagagagaaaagcaggcggagcattgactaagcacccactctgtgccgggcccttcgcacacaacatcccactgaatccttgtaaacaccatgcaaggctgctctgtgaagcgcattttatagatgaggaagccaaggctcagggggatgatgtgacttgtcacaagctggctggaggggacagagaaagatcttaggcttacttctgtctacccagaacgcaaggctctttctgctcaatgtggactcaggataggaccagggtgagagagattcagatacatttttgtgcccaggggacagtcccagcctctcaagatattggggttgggggggggacttgcctctgagc

SEQ ID NO: 56409 - DNA, 158 bp, Homo sapiens
tgtatatactcagcctccaattcttctttacttgaacctactccaccaagactattcttgtcaagacagccagtgacaccagcattgccaaatccagtagctatttttcagtcctcatcttgcttgacctatcagcagttcttgttacaactgacact

SEQ ID NO: 56410 - DNA, 1413 bp, Homo sapiens
gagtatctggatgtcttggattttcttcccattctgttctgttctgttctcctaataccatctcgttactagacgtaggcattggacgtgacaatcaactgcatttgaactgagaagaagaaatattaaagacacagtcttcagaagaaatggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctagcttttcaaggaaaaatgctgcttctcctcccagcgtgtgtatccgactctaagctgtgtgcagg

SEQ ID NO: 56411 - DNA, 1422 bp, Homo sapiens
  misc_feature (1)..(1): n is a, c, g, or t
  misc_feature (5)..(7): n is a, c, g, or t
  misc_feature (10)..(10): n is a, c, g, or t
  misc_feature (12)..(12): n is a, c, g, or t
  misc_feature (14)..(14): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (102)..(102): n is a, c, g, or t
nccgnnncgncngngccggcgncncgngcgggggaagctggcgggctgaggcgccccgctcttctcctctgccccgggcccgcgaggccacgcgtcgccgcncgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagaga

SEQ ID NO: 56412 - DNA, 1223 bp, Homo sapiens
  misc_feature (1017)..(1017): n is a, c, g, or t
  misc_feature (1181)..(1181): n is a, c, g, or t
  misc_feature (1194)..(1194): n is a, c, g, or t
  misc_feature (1215)..(1215): n is a, c, g, or t
  misc_feature (1221)..(1222): n is a, c, g, or t
ctcggtcacgggggcggcgcgcgcccgggaggtggggtctcattcccccgacttcctcagggaggacccctgccctccgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaaccttagagtttggtctatatttttaaaactaaanattaagttggtggtaaatacctgcttgtttaattctagaggcacccaggagggagggggcactaatataaacaaagcaatgaaaaactcaaataaagcagctactgacaggcacaagcatgttattttaaaagacagctttattattattccagtttggtattnagagggcttagtngcatctcttcatctcttactntctccnnc

SEQ ID NO: 56413 - DNA, 1663 bp, Homo sapiens
  misc_feature (1)..(1): n is a, c, g, or t
  misc_feature (5)..(7): n is a, c, g, or t
  misc_feature (10)..(10): n is a, c, g, or t
  misc_feature (12)..(12): n is a, c, g, or t
  misc_feature (14)..(14): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (102)..(102): n is a, c, g, or t
  misc_feature (1457)..(1457): n is a, c, g, or t
  misc_feature (1621)..(1621): n is a, c, g, or t
  misc_feature (1634)..(1634): n is a, c, g, or t
  misc_feature (1655)..(1655): n is a, c, g, or t
  misc_feature (1661)..(1662): n is a, c, g, or t
nccgnnncgncngngccggcgncncgngcgggggaagctggcgggctgaggcgccccgctcttctcctctgccccgggcccgcgaggccacgcgtcgccgcncgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaaccttagagtttggtctatatttttaaaactaaanattaagttggtggtaaatacctgcttgtttaattctagaggcacccaggagggagggggcactaatataaacaaagcaatgaaaaactcaaataaagcagctactgacaggcacaagcatgttattttaaaagacagctttattattattccagtttggtattnagagggcttagtngcatctcttcatctcttactntctccnnc

SEQ ID NO: 56414 - DNA, 2270 bp, Homo sapiens
  misc_feature (1)..(1): n is a, c, g, or t
  misc_feature (5)..(7): n is a, c, g, or t
  misc_feature (10)..(10): n is a, c, g, or t
  misc_feature (12)..(12): n is a, c, g, or t
  misc_feature (14)..(14): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (102)..(102): n is a, c, g, or t
nccgnnncgncngngccggcgncncgngcgggggaagctggcgggctgaggcgccccgctcttctcctctgccccgggcccgcgaggccacgcgtcgccgcncgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttattttttttccatgtgctgtgctttcctcaagagaggctcgtgtgccaatctcgagccccctgtgataagaggaagaggcctctccacttatgtggaactttctcttcttattttatacaaagtggttacacaatctcgagagaggaaacctattatagaacaccactcttttagaaaataatacaacacatctcccgtgggaatctcacacagcgtggccccgtgtacaaacaccccatatgagctcgagcgtataattctcttatattttctcaatctccttctcccctctgggaggggcggaaaaaacgaagaaatatatacagcgtgatcacgtggtgtgctcaaacaaaaacaaacaaacaaacaaacaaaacaaaaacacaaaaacacaaacaaacaacaacaacacaaaacaacaaacaaacacaaacaaacaaacaataaaacacaaaaatataaccaaataaaacaactacacacagagacacacagagacacaaacacaagatacatatgaataacgacacaaccaacacgacaccagaacgaacaacaggctacatatgacctaatcacaatctacaatgcgacaaaaaataagagcaaacacagaaacaaatctgctatcaatcacaacaacattatcctttacatgtaacaataaatacaacaacaacgagtattctccaatccataatatgtttagatccacgtaccgctaaaatcaacaacatatatgattagtaagcataatcaaaatcaaatactataaaaatatccaacctattcagtatcaatatatacataataaataaatatagaaattcaattgtatcactctccactattacacaaaattatacaggatcaccaagacaactaccaactcctcctttacatatcgtatattgcatcaaaaattaaatcaacaaaccaactcaacgaaaaaagaccacagacacaataaaaaaaaaaacaacaagcaatcacataacaacaagaatcaaaacacaccaaatatatcaactcagtcaaacaaaaaattatcgtcaaacagatcctcgaacacaccagcatccaccctcactctaccatactcttacaactcgactactactaaacgatgatacgcaatagcagaaaccattctgaacaccacacaaaccagcacaacagatccaaaaaacacaagcaggacaattaaatcagacaga

SEQ ID NO: 56415 - DNA, 2106 bp, Homo sapiens
ggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtaatgattt

SEQ ID NO: 56416 - DNA, 1733 bp, Homo sapiens
ggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtaatgattt

SEQ ID NO: 56417 - DNA, 1652 bp, Homo sapiens
ggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtaatgattt

SEQ ID NO: 56418 - DNA, 347 bp, Homo sapiens
ttgacaaaaaagcaatgttgcttgtgtcaagaagaaactgaactttgtgaagagttgaaatggaattccactgaattagaaaaacttgttttctcctgcctggatacatacagtcagggccattgatgcacaggtgttcctggctgttgttacactttaccctctgaaatgatgctcccaagtgctatgtgatgagctccttgtgtgcccagtggaataggtgtgtccatgtgtcattttaaagactattaattacactaatatagtttctttctctctttggataataggcacgttgttccgtatggacttggaagccctaggtccaagagagccttggagaattt

SEQ ID NO: 56419 - DNA, 1808 bp, Homo sapiens
ccaagttccttgtagaagccagccggattttcaacaggcagcattccacagcatttccctgagcctgcttcaagaggggtgggggaagtcccttttcagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtaatgattt

SEQ ID NO: 56420 - DNA, 1853 bp, Homo sapiens
ggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtaatgattt

SEQ ID NO: 56421 - DNA, 678 bp, Homo sapiens
ttgtgctgagtgatcttcacacccttccgatttaacacatccagctgaactgatagcccttctctattctagtctacagatcctctgttctatagtgttctttctcttaccccttgacattgatttattcagttaatacgtatcacttttcacctgttattgtttctgcctattaaatatctctccaaattgtcttctgtcataattgtatcctaattggacttcctgtcttcatttttcagtcccttacactgtgacctctgggatctttctaaaaatgaaggttgaatgtctctctccagttttattaaccatgcagtggttccccacagcttcagcatcaaactccttagcttggcatgcaggatgctttgattgccaacccctcacaccatatgctctccatagtaaactaggagtcgatcagctttacagtgttctctccccttctccacaaaaaagtattctctgcacttgaaatgcccttccttccgacttgatcctccaagggtatggttaagtctgatccctcctctggaatgtgttccatgacaccagcatgtcttccttctgccaccagccaccacacacaacatctgaattgatagacttcttcttttccttattcctgtgttgtcctgggcatgaattcaccttagtatgatatcattgcacttg

SEQ ID NO: 56422 - DNA, 431 bp, Homo sapiens
tttgtatttttagtagagagggggtttcaccatgttggcttggatggtctccatcccttgaccttgtgatccacctgcctcagcctcccaaacttctgggattacaggcatgagccaccacacccggcctgcatagttttttataagcaccttctcttttcatcctcccagcaagcttatgggcaggtgctatcattttctctttatagatgggaacactgaaactcagggagattaataacctgtctcaatatcacatagtctgtacctggcaggtttgggtttcagacctcagtctatctcactcagatctcttgttctgggctgggcatggtggctcatgcctgtcatcccagcactttgggaggccaaggcaaaaaggtcagttgaggccaggagttcaagaccagcctgggcaacatagcaagacc

SEQ ID NO: 56423 - DNA, 338 bp, Homo sapiens
agattaacgagatatatccctgacatttgaacatcaaaggtgcttcatgaaggaccttttaaaaggggactgagaagtttgaagtggtcactcatgcttcttcaggagttgggcccttgaaaggaaaagcagcattgcaatagaatagcaccctggttgaattgaccactcccatctttaggcccccaaaaacctttgtacacaactctatgttagcatgttagcacttgctctattaatgccccacccccacccactcccaactaaaactacgttctctgttgcccaggctgaagtgagtggcatgatcgcggctcactgcagcctcgaactcctgg

SEQ ID NO: 56424 - DNA, 292 bp, Homo sapiens
agatacaaggagaagacaaaagcaaacaatgttatggaggtaccgtctttattattcaacaatctgttgagtatggagggcagtgaccagaaaaccccacacacttctaagtcctggaataatcagaagaatagtaccttctgggcatcatttattttagtgtactctgaattatgaaactgcttttcttccccttccccatagagatagagtgtctcattctattgcgtaggctggaaggcagtggtgtgatcacagctcactactactacaacctcccaggctcaagcta

SEQ ID NO: 56425 - DNA, 2077 bp, Homo sapiens
  misc_feature (229)..(229): n is a, c, g, or t
  misc_feature (289)..(289): n is a, c, g, or t
  misc_feature (2067)..(2067): n is a, c, g, or t
  misc_feature (2070)..(2070): n is a, c, g, or t
  misc_feature (2072)..(2073): n is a, c, g, or t
  misc_feature (2075)..(2075): n is a, c, g, or t
cacaaaagaatgaagaacataagaaaaggtaactacatcagtaaatatattgcttttttcttcttatttaaatgctttaaaagagaattgattgtttaaataaaaatatcaatgtaggctacatgcagtggctcacacctataatcccagcactttgggaggctgaggtgggtggatcacttgaggtcagaagttcaagaccagcctggccaacatggtgatctttgtntctattaaaaaatacaaaaataagccaggcgtggtggcgggcacctgtaatccagctacnctaaggctgaggcaagagatcacttgaatccaggaggcagaggctgcagtcagccaaaattactccactgccctccagcctaggcaacagagtgagaatctgtctcaaaaataaaaataaaaataaatcaatgtagtatcagacttatatgtagaaattaaatatttgacaaaataacatgaaattataaggagagaaattaaaatttattattttaaggttcttaatatacaaactagtatattatcagttgaagatagtctgcaataatttaaagctatatactataaacactaaagcaaccattaatatagcaaaattgaaaatatgaagttaatagggcaacaaaggagataaaatgtaattttaagaaatatacaaataattacaaaaagacagcataatagtaaaagagaatgaacagataaaacaattataaaacaaacaccaagctgagagacttaaacctaatcacacgataatcacactaaatgtaaatggtccaaatacccccatcaaaaaggagagactttcaaatagataatgaaaattcaagacctaaccacaaaaaaaacacacttagaatataaagtcacagatagggtaaaagtggaagaatgacaaaagaagagacattcttcaccaagagtcctcggggtttcctgcttcagcagtgcttggacggaacccggcacttgtcccccacccaggccagctgcccatagccagccctccgtcacgtcttcactgcaccctcagaccaccccaaggcccccaccgccgctccagcgccacgcagccaccgccgccgcagcctctccttagtcattgccatgatgactgcatccaactcgcaggtgcgccagaactaccaccaggactcagaggccgccatcaaccgccagatcaacctggagctctacgcctcctactttaacctctccatgtcttactactttgaccgtgatgatgcggctttgaagaactttgccaaatactttcttcaccaatctcatgaggagagggagcatgctgagaaactgatgaaactgcagaaccaacaaggtggctgaattttccttcaggatatcaagaaaccagactgatgactgggatagtgggctgaatgtgatagagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaacgtgaccaacttgcacaagatgggagcacccgaatctggcttggcagaatatctctttgacaagcacaccctgggagaaagtgataatgaaagctaagcctcaggctaatttccccatagctgtggggtgacttccctggtcaccaaggcagtgcatgcatgttggggtttcctttaccttttctataagttgtaccaaaacatccacttaagttcttttgatttgtaccattccttcaaataaagaaatctggtacccccccccaaaaaagaatgacaaaagatagcacatgtgaatacaaataaaaagtaagctactgtggctacattcatgtcagacaaagtaaatttcagagtagagaatattaccagtaataaatgattatttcatagtgataaaggggtcaattcatgaaaaagacataatcctaaacctaatacaacagttcaaaataaatgcagcaaaaactggaaggagaaagaaacagatctcnaantnnantc

SEQ ID NO: 56426 - DNA, 416 bp, Homo sapiens
attagcagaaacttcaggcatgagaaacataccctcagaggcctagaatctatctagtgtctagataatggagatatgaaatacagacacttaaacaactatgtttcccatgttcaaagaggaaatttgcaaaacttgaaagtgttggcaggaaatcagaaactataaaatgtgacaacagcatactttagagtcagtataaattacggtcccgaaaactgcagaattccagaacttaatggtaaagcaagggtttaacagcagaatagaaatagccagagagaactaggaagtaagtcagatgacactacccagaataaggcactgagaggccaaggaatggaaaatgcagaagaaaggatatggtgagaggatctaatatacatttatttggagtaccagggagagagagaagg

SEQ ID NO: 56427 - DNA, 318 bp, Homo sapiens
actgtgtaattgatttctaggtgtaattgattccaattgtgtaattgatttatgtgactgtttatgatggcaagtgtcatcctttagtttccatgtttagaatgcctttgaatattccttggctggccagtctagtggtgatgaatttcattagcatttgtttttctgggaaagcctttatctctccttaatttgtgaagcttagtttggcaggatatgaaattattggctggcattgttttttctttaataaaactaaaaatagtcccccagtcttttctggtttctgctgcaaagtctactgttagtctgatggga

SEQ ID NO: 56428 - DNA, 248 bp, Homo sapiens
tgcttgtttacaggaaggttttgacacctcactcctttttccttgcctgtccattggtttgattttgtgccgatgagactcccattaagaggcattttcctccctgggttatgcctttcttaggtataattcagtcctcttttctctcacctcgtctcctgtcttgccatggccatgatggacatttatatagttgcatcttccccccaaaaatgaagtgaatacaaagaaagagagagagagaggga

SEQ ID NO: 56429 - DNA, 404 bp, Homo sapiens
aaaaaccaatttctctaaagagggaaaaaaataaaaataaataaataaataaatcatcctattctttacagtatgttgtcagttaacttattattcaaaagtgatagcaagctctcctgtttaaaagaatacagtctgtctgtctatgaagaaaacgattgtttcacactgcctctgctttgcagtcctattcagctcagacaatttgcatcaacctgtgactagtgacactgtcacttagtggtgccccagaaagccatgatctcacgtgctcttaatattgaagttcttatttatacatagatgtctctggaatactcatgaattcttacttgaatacaatggtgttttattaatagttattaattaaattttaaaatgctaatacataatttatcaattta

SEQ ID NO: 56430 - DNA, 216 bp, Homo sapiens
cctggtggaccctcagggtctcacacgccaggctgggtgggactcgggagagggactgagaggggtgagatgctacgatacttcacaagtgttcaattatgactttaagttttacccatttagttttgttttatttgacaaattatggttttatatttttattgtaatattgcttttttcaattcattttacatttcaaagtaaaaccatttgcct

SEQ ID NO: 56431 - DNA, 503 bp, Homo sapiens
gaaagagatattaatagtaactactgtggcagatggcattttccataaatgcctacaaaatactttccatctcagctgctcttcagaaatgaccttgccattcctccatcaacagatgaaatctaattccccttcttttgcatctgggctggcctcagggacttacttgggcattggaatgtggcaaaagtgatggtctgggacttccaaggctagttcatacaagctaagtcattctgtgtgagtcttttgggatgttccctcttccaacccagccaccatactgtgagaagcctgaacacttggaaagccatgtgtaggtgctctggctaacagtcccagccaacagcaagcatcaactgcccaccgagtgagctctcctgacatccagcacctttgggccttctgaagactgcagcaccagcccacatctgggaccccaaaaagaatgggaataaactgagcccagttagtatacaaaccaagacagataataataaatg

SEQ ID NO: 56432 - DNA, 429 bp, Homo sapiens
ctactacaatttacttatcagatatctgttctgtgccttgtgaccaggttctatggctatatttcctaggagagacagggtgaaagcacttactctatcttatctggaagcagaactccccatatttacttttttttttttttacttccaaactaattgtataaggccaacattaccctcataccaaaaccagacaaagacacagtgaggaaagaaaactataagccaataactaataaacatcaatgcaaaaataacaaaatactagcaaactgaattcaacaacacgttaaaatggtcattcattataatcaggcgggatgcatccctgggatgcaaagatggttcaacatatgcaagttaataaacatgatgtatcacattggtagaatcaagggcataaaccatatgatcattttaatagatgtc

SEQ ID NO: 56433 - DNA, 491 bp, Homo sapiens
acagctgtgaaaaaataaaaagaaatacttagaaacacatttagtcaaagaggtcaaagatctctacaaggacaactacaaaagactgctgaaagaaattttagatgacacaaacaaacaaaaacatatcccatgctcatggatgggtagaataaatattgtgaaaatgaccatactgccaaaagcaagctatagattcattgcaattcaaaatgccatcatcattcttcacagaactagttaaaacaatcctaaaatccatttggaaccaacaaagggcccacagagacaaagcaataccaagcaaaaataacaaatctgggccaggcacagtggcacacgtctgtaatcccaacactttaggatgccaaggcaggcagatcaagaggtctggagatcgagaccatcctggctcacacggtaaaaccccgtctctactaaaaatacaaaaaattagccgggtgtggtggcatgtacctgcagttccagct

SEQ ID NO: 56434 - DNA, 490 bp, Homo sapiens
gttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaagttgaggaagcccacatggcaaggaactgtgggcagccttcagccaacaggcagcaaaaagctgagctcctcggagctacagcctcaaggaagttacttctgctaacaacctgaaaaagcttggaagctagtttctctctagtggaatttttagggaagagcatggcccaggcaagataaataatgtaagtggaaaaacctgtcaacaataaaggttttaaaggaaaaaacaaaaaaca

SEQ ID NO: 56435 - DNA, 456 bp, Homo sapiens
agaccaggccagggaagttgggctgttgtcccaggagcagccaagcctggggtgggcagggctgggctgggttgggctaggctgggcagagctgagagagagaagagaattttttgcctctccgctcataaatgcctatattgggcaaggcctctcgtttccttgggcggtgaccaggagtctctccaaatttgccagcctgggttgaattgtctctctgcctggaaagagattgcatccttctagaggatccccctcagtcctcaagggaataagaatggatgctgacccctgcagcctgacctcccagaatggatagagagatgtgagcaaattccatccaagagggtgggccactcattacctctgctaggctaggatgggagccacagcgggggacaactgtttctgggaaccacggctcccttgggttgctgatccatgcagtcactgtac

SEQ ID NO: 56436 - DNA, 442 bp, Homo sapiens
aaacatacattgctgaacacaaatgtaagtttgttcttggcttattaaattttagagaaggactaaatatatttttgcctgttaatacacaaagtaattatgtaacgggaaaacatgtttccaaaaattataaaatggttctcatctataaaatactgattccaaggttttcactaaaaattacagttactaagagttaaagttcttacatatatatatttcagtatacaaagtatacgaaaagtaaggtatgtttctgatgagaaaaattatgagaggaataaaaatgtgttctttattgaaaaaaagagtaattttgtctagtttggagattatttaaaatttgtttcaaaatatggatttagaaagcaaagagaaagaaaccactaagtaggagagcgagagatgtgaagaaagttataggtatgtagatgtatcttag

SEQ ID NO: 56437 - DNA, 1766 bp, Homo sapiens
caacctgcaagaggagcctctggctaaaggtcagttatttcgcaggctggagattaatcacagagctcaagaatatgaaagcaaagagaaacagaaaggagggagaggtggaaaaggaacctgtaacctccattttctctctctgggagccacatatagtgaagaaaaagcatcagggttgggaggtctggtgtggttaggaggtccagtgtgggtggtattctaaatgtcaacataaacggtaagtccacccacttccctctaccagaactttgccctttactgcttctaaaaggatgggtcatagggaataaaagagggagacaggataagaggaaagcaaagacattacctcgccttttccctttaagaccttgggcaagtcacactgcctatcctgggctgcctgacatgctagctgggaattttctgactttccctggcatcactgtagtattacagccagatcataacctgagagctgatgcgcttcctcacctaaaatggaacagacgggagggagggtggaatgctgtttgtgttcaggtatgagtcattaccatgcatcccacttccttgaacctgactcttaattgcatgctttagccaagattcagcaaaaggagagcttgggagtaagtctccattggcagagagcacccatgttgtttgctgctcatttttctacccatgggaaaaagaactcctaacctctggagtcagtagtctggccacgaaaactcatccaagtgacttggggaagagataagattccctggccccaggtggtgcagagaagtgggtggtacctcctggagtccccattccttctattatatgtggttttcatagtggattagaggcttcatggcagtgaagtgccaataagaagaaggtgagatctggagttaaacatgtcttgattttatatcccggccccatcacccaccgctggtgggtgtgaccttgagcaagtcactgaagttgtctggtacctaggatgccacacacacccacccacccacccacacacacatacacacacagagcaaagagtaattgcattttggttctgatgcacatgagagactggcaggtttaaactcctcgatgggccagcaactgttgaaaggctcttcagtttctctttggaataaaaataaacaagttcaaaaagaaaagaaagcaagttgaaaagggacatgtattctttgaggaagcagatttgccttcagtggccaaacaatgagttgtgaggtttttccactggatcatttatacttttttgtatagataacagcagaggataaaactagtaatagtagaaataattaaatgtttactctttaatagtaaataataagtagttaaatatttaagaatagagtcattaattttgtgtgtgtgtatgtgtgtacctaacacagaggcaagggcttcatgtacagtatctttgggggattctaacccggaaaattctaacctcttgatttttttaaaatctttttaagaggcctcctcttactttgttctaatcgcctttgggacatctatgggtctctttgtcagaaaagacccagaagcctgggcttatagtatagaagtggggagaatcccctaccactgtaagcaacgagcattgtttttatttaatgggagtcacattgtgctgtcttgctgcacggatagccaattctctacatcttataacacaataaaccagggaggagaggggaagggaaagtacaagtcccctttggtgaaaa

SEQ ID NO: 56438 - DNA, 449 bp, Homo sapiens
gtaccctaggtctagtaacagcagggagccagctgtaacaaccaggttcctcccctgccttcactagccatccctttccctacaccacacacacacactgagagaaataataaggacaaggttgggggacctggaagaagaactgtatggagaaatgtgctgatagaaaccattgcctcagtggaagaaagcaacaaacccccagcaatccggcagagaggaagctggggaattaatacaccaacatcattcttttctatcctgtctcctattggtgaatacaggaccagaactaggcatacagtttaaagaggccctcgcagtaccctggggtcctcattccttttaccctaatcccagccctgagcaaacccaattaaagctggagggcaaagcagcctgttggaattttgcagggcacagaggaagtctgagagagtagagagcaa

SEQ ID NO: 56439 - DNA, 345 bp, Homo sapiens
gggaaggtggggctccagttctaagtaccgttgtcaccaagtgaacatccttacagatttctagcaaaatgctgctcagacccctttccgaggccgcatggcctaatcgtcctcggagagactgactgactttatcgggtgctcgcggagtgccagacacggctttcattacattcggtccttgtgggggcctgtcaggtgggcggcacagatgctgcagtttcatgggtgacgatattgaagcacagaggagtcaggtcacccgttcaaggtcacacatggagtaggaggcagggccctcaccaccacctcgccaggggcctcattgtgaactcggaaagggcc

SEQ ID NO: 56440 - DNA, 89 bp, Homo sapiens
atgcttaatagcctaccatttgtcaatattacgtggggagcatattaaagccagtaagagatcaatttccccaattttttatcattcat

SEQ ID NO: 56441 - DNA, 521 bp, Homo sapiens
ggaatgtgctgcaaggcgctgcctcgctctggagccagacgagaggccggagcatccgccccaacatggctggctgtgtgagcctcaggaacgctggcagctctgcaagactctctgccatctgcaaaataagtatgaagatatggtttccacaccaatgttaggccttctcaaggagcttagagtgtgtcggtggagagggagaagcccaacgggagatcttattccacctctgcacgtcttcaggacccctgtggaaacatgtgatctctaacagtctctctggggctctgcccacccccagcagtgtcacctcacatcaccgcacaataagaactttctcatcatgaacatagctttctctggagaagctgggaagtgcttaactatgccagaagctggacaattcaggtagaagtgtaaatgttggcctaaccttcaaaggacagaaatagctttctttgaaagttctcaaaggtgtttcagaactctggaaaattttaaatcttaaaataacacta

SEQ ID NO: 56442 - DNA, 311 bp, Homo sapiens
ctcaaaagacaagttttggaaagagttcaaagaaaaaattgaaaaagataatgaaaggtttgggtgatgagatgatgatgaaaggctaaggaaatccaaattctttgttctgaaaagccgagatctgagaggtccctggtttggtggaaggttatcgtatctggtacacatgctccggggaggcttggccaagataaaataagcacaaagggctcaagttagctaccaggagggactttctgacagccatgtactttaaagtttttatttttattcttgaaagcttcaagaaagctgttacctatctgaaa

SEQ ID NO: 56443 - DNA, 1538 bp, Homo sapiens
acagggtttctccatattggttaggctggtcttgaactcctgacctcaggtgatccgcctgccttggcctcccaaagtgctgggagttctccttacttgggttgaataattatcagctcatggctaaacttgcttcatacacagtcaagcgtcgcttaacaacagggatgtgttctgagaaatgtatggttaagcaattctgttgttacgtggacatcgtagagtgcacttggacaaatctagatggtatagcctactacacacctggggtataatggtacagcctgtggctcctaggctacacacctgtacagcatattactgtactgaatactgtaggcaactatagcacagtggtatttgttatctaaacatatctaaacatagcatagaaaaggtacagtaaaaatatggtataaaagacaaaaatggtacacctctatagggcacttaacatgcatggagcttgcaggaccggcagttgctctggtgagtgagtgagtgagtggtgagtgaatgtgaaggcccgggatattactgtatacttctggagacttgatagatgctgtgcacttaggctacgctacgtttgtaccagatagtttccctcttcaataataaattaaccttagcttactgtacctttattaacttgaaattttttttggctttttgactcttttaacaacacttaatgcatacattgtatagctgtctaaaatactttctttgtatccttattctataaggttttttctattcttaaattgtttaatttttttactttttttttgggtggagacaagttctcactacattacccaagttggtcttgaactcctggcctcaagcaatcctcctgtcttggcctcctaaggtgttgggattacaagtgtgagccactgtacctggcctatatttttactttttaaatgtttttgttaaaaacgaagacacaaacacacacattagcctaggccttcacagggtcaggatcatcaatatcactggtctttcgtctccacatcttgtcccactggaaggtctgcaggggcaattacatgcatagagctgtcatctcctattatgataacaaggccttcttctggatacctcctgcaggacctgcctgaggctgtcttacagttaacatttaaaatatatatatatgtagaaggagtacactctaaaccataaaaaacagtaacatggtcatttattatcattatcaaggattatgtattgtacataattgtatgtgctgtacttttgtatgactggcagtgcggtaggttggttcatacaagcatcaccacaaacacacaagtatgcattgctctagggcagtacaacagctaccatgttaccaggtgatagacaatgttcagctctattatcttgtaagatcactgtcatgtgtggtccatctctgaccaaaacgttatgcagtacgtgactgtatcctcatcctcaataatccttggttattattctagaatttgaaataaatggaatcatatcatttactatgtacattt

SEQ ID NO: 56444 - DNA, 405 bp, Homo sapiens
cattttcttattatcctcatttgttgagttttaccaatgaactattggaattatcatgtcatttaaaagaaaatcaaacaatgacagattgtaataaggattacactgaatttatattaatttcaggaaaaaggacatatttacattacctaacaataagctaggccagccttccctttaaattaattaattatacaaatctgttttcagaatcatatttccttggtattggttagcatacattcaataaaatcctactgaaaaatttgtgtttagtataagcaaagtaatttttttttgagacggagtcttgctctgtcacccaggctggaacgcagtggcgtgatctcggctcactgcaagctccgcctcccggtttcataccattctcctgcctcagcctcc

SEQ ID NO: 56445 - DNA, 349 bp, Homo sapiens
agcacttgttggagaaaactccaggagtcaggagcagaagtgagcatgtggatcacctgttggacataatggttctgcagcagtgcacagagggcttacagggcctggcatctgactgtgggagagggacttaacccttaggagggttttaaacttatgtctcctagaaagactaggagtttggatccaacagcagtaagaggcagcgggacctgtctctggtttaattccatcagctcagattcatggctgaggaacactcattccatcccttggtgaaccagggtttgaagtccaaaccttgcagtctcagtttccatgacatggcagatgggacctgatttgccac

SEQ ID NO: 56446 - DNA, 274 bp, Homo sapiens
gagatctaaatgaaatttataagaaaattgtgggttctgcccaagatgacatctaaattgaagaaggtacacagtgagtttaaaggatcaacgagagaaacttttattattcatttgcacaagaagacacattcagtatctggattatccaatatatggaatactttgagttgaaatgattaaagggtaatctttaatcattaattaacaaatcattaattaaacaaaataatatttagcaaattaagcaagtgctaaaggatacatgcaaact

SEQ ID NO: 56447 - DNA, 448 bp, Homo sapiens
tattatcctgtgaccctgccacaaccccctctctgagaaacacccaagaatgatcaataaatactaagagagctcagaggctggcaggatcctccctatgctgaacgctggtcccctgggcccccttatttctttctctatacattgtgtctttttcttttccaagtctctcattccacctaacaagaaacacccacaggtgtggaggggcaacccaccccttcagatttctagcctgaaaaatggaggaacaatgtctgtcatataaagttgctgtaaagataaaaccagctaagaaatgtaaaatactcaacagtgcctgacacaaaataaacacccaattaatggtagcagcaagaaaagagctctcttcaaccaacatcttaccttcagaaattggttaagaagaaatgagtgcttgggaaccttcctgttagagctgggaaca

SEQ ID NO: 56448 - DNA, 381 bp, Homo sapiens
tgcctcccaggttcaagcaattctcctgccttagcctcctgaatagctgggattacaggcatgcaccaccatgcctaatttttgtactgatgccagcactttcttagcaaccccagctggtgtcctagtatgccccctccagtccactgtctctgggcccagttcagcgctaggacttgcttaagagtttcagtccttgtagcctatactgcctttcacgtttatttagagatctagagcactttaaccctcagtggcaaggtttgtgggaacttgagttcggaccactgggattggcaattcccctctggctagggttgctttaaatgctcccttcacgtgtgggcatcagctgagtttggtccagttttcctttctgct

SEQ ID NO: 56449 - DNA, 239 bp, Homo sapiens
gttctaagataacgcgagactagctttatttttttctgtgcttgggcagagctgtgaccagccacctggaacatcatattggattctgactccctttctttctgccccaaattaaagtaccttttctttggtatttcactgaatctttaaagtagtcaatagtaaacaccattttgtaaataaagttgtctcatctggtaactacaaaatacaaatatatctttcagacacgatttcag

SEQ ID NO: 56450 - DNA, 555 bp, Homo sapiens
cctggtccagtcaatctcttgggccctaggtaaatcagataccacctcctcaagcttgtctgtaaaaatcccctgcatttcaccacgagactagaagaccaacttaagagcccctccctctctgcagcagaaagagctttactctttcttttgcctactaaacctccactcttaacctcactccttgtgtgtgtctgcatcctcaatttctccaggtgtggggcaacaaacctctggtattaccccagacaaataacgctgcttcattataatgcattagcatgctaagagacactcccgccagtgccatgacgttttacagaagtcatcctatatggtctagaaagggggaggggactctcagttccaataattacccccctctttcctggaaaactcatgaacagtccacctcttgtttagcacataatcaagaagtaactaagtattatcaatcaagcatcccaagctgctgctatgcgtatggagtagccattatttattcatttactttcttaataaacttgctttcacattactgtatggattcaccct

SEQ ID NO: 56451 - DNA, 383 bp, Homo sapiens
cctccacctcccgggttcaagcaattctcctgtctcagcctcacaggtagctgtgattacaggcacacgccaccatgcctggctaatttttgtatttttagtagagatggtctactaaaaatcaggctggtctcaaactcctgacctcaagtgatccacccgccttggcctcccaaagtacagagattacaggcataagccaccgtgcccagtgccagtttcttatataagctgatttggaggaagaaaagggcctgttgtttgatgactctgtggccccaggccaagccctgtggaagcctggagtatacggccggggtttgtggcacaggcgaggggagccacaggtgaaggtgtgcaggtgcgcaggtgcgcagggctcc

SEQ ID NO: 56452 - DNA, 2351 bp, Homo sapiens
ttaaatatgcctcaaatgtcattccaggaaaccaaggaccttggaaggcttcccactggaaggtcagtggagatagtggaaatcacagaacagtttgcaagtagcaaggaggcagatgaaaagaagaagaagaaagggaagaaataaaatctacattcctacagcatgaaaccaattaccaagggacttattagataggcaataaaaatctggaaactttctctctcagggctgagccaagatggagataaactgatgcactaaaagcaaaccttgaattatttaccatatcaactattataaagttacactattttaaacataatccaaaatgtttccataagcaacttgatctctctcctttattttgaaagtggcagtatcaaaatggaaccattagcagcttgctaatattttgatgcagaaaaggaatctcattattctattttactcacatcatctttccactacaaaagcccatggacaaaatagctacctaaatttgtttcggtaaaaaatttactgtaaaattgaaaaacagcctgaagctactgacattaagtgctgtttgcaggagcaaaccagtgattttctattaattgttaatcatggacagaagattttaggcagctcatttttttctaaagtgattcaaaatagttttgtgtgggaaaaagctcttctgctgattacatatagctataaagattaaaacctagccacctgctcagtttgatcttccccagctcagacctctcccttctgagcagatgatagaggtaagatgatacatgagaacctccaatggctcctgtcatcacatactgtataaaatccaagttcctcttactggctttcaaggatcctcctttaacttcctgttgccttgtctcatcagcaagatcataagtacctacaggtcaagcactgtctctcccttctctttagcttttcccttaggatctagcacattacccagcaaaatgtgagtagcaaggctgaaatgacatctcaataacttcaccaatgattgtaactcagcatcccttctccatcccagctgaaagcctgcttcaccatcctgcaagagatgttttttctttttgttagcatccattcccctttctaatgcagctcccaatgcataatgtgtgttttacttccctctttctgactccatcctcgtcaccagtgaatatttgtaccttctcttaaaatcttcaaaacacacttctaggaagtgctccttgattaatcctctaagcacttaaatgaaagcactttgcttatgcttatttcacatttgctgccacttgcctctttgaaatatgtaaagatacattacaagaaaaatgtacattttctcgtaacttgctattaatttttttctttatatatatatataaagtaatcctaagctaataaaagagtttgccatgacattaaaacatttaatactccataagggaggaggagaaagaaaaacatattttaggaatagcaattagtattgtggttaaaataaacatgaataaaaattttaaaacaaagttttaatgttagcatacaaattttaatggaattactggaatatagttttattctgggtatatagtgagtattatttaaagaagtactgttgaggtttatttttatttcatgaaatcctatgtccacaatttgggatactgagttaaaaagatcccaacatgacaaatccagcatctctgatcattattaaaatagatccaatttgttgccagaaaatggcagactacaacatgaaccaggctacagagaatccaattagaaacatggtctgaaatagatgatgaactgaacctggatatcagtggtatataacaaaaggagaagttgtcagaactataggaaagaaagtgcctttggcagttaaacttttgtactggttcgataagactagggctacaaagaagattactcacaggtcgtaagtccaggccaaccttagacaaaagactgttagaagagcataaagatatactgtccaaggcaagtaatctgtttcctcatctgtaaaacaagaaatgtgggctagttcatctttaaggttcctttcagctccgtctgctataagaaggcatatagcaaagcaatagttccacaaagtgagatcctgcagtgcagtgattagctttccttgctcactacgcagtgattcttggtcatatcaggctggccggggattgagagagagaaattgggttgctccacccctcttcagccaactggcaatggtgatatggaagaatatctctgccaccacacatatagaactaatggaaataaagaaaatagaagtaaattaaggt

SEQ ID NO: 56453 - DNA, 395 bp, Homo sapiens
gggtgcatgactccccaaaagcccaccatgagccattcactgaaattagaaccccagtcccctgatgcaagctggtgctctttctacagcatcacatcatctctttgaggaacaagattattggaaaaaaggcaccaactcgactgggaatttaagatctgggtttgagtaccagttctcaaaagttctgctttccaattacttttccttcattaagtgctgaaagtgaagactacataaaaaagttgtgtgaaagtgcctcataaccaaatttaacacatagtgggtgtttattaataaacgctttttgaatctgaatccctcaggggagtaagatttggctaaggtaatccatgtgaacatattatatcaaagtgtagtgtgatacagaaatg

SEQ ID NO: 56454 - DNA, 874 bp, Homo sapiens
tcttactataaagtaaaaattattgtaggccttctaaggaatttataattcattaaaatacatataataacactaaaaagctaattaatatataatattctagttaaaaattaggcatatatgactatatgcaatagtgtggaaaacaattaggcatggaaattattgttagagtttattatttttcaaaagataatgataaaacacacctgtaaatttaatataattataaattcgtcaaatctcaggatggtaaaaccttaaatataccatttgtaactgacattatgtattctctttcttcttcagaggaaaaccctgaaggaactatgggaaatttcttttttattttatttatttatttatttatttatttatttattgagactaagtctcactctgtcacccaggctggagtgcagtggtgggatctctgctcgcctcaagctccgccccccgggttcatgccgttctcctgcctcagcctccccagtggctgggactgcaggcgcccgccaccacgcctggctaatttttttgtgtttttaagtagagacggggtttcactgtgttgggccatggtctcgatctccctgacctcatgatcctccccgcctcggcctcccaaagtgctgggattacaggcgtgagccaccaaggccggcagaactatggaaatttctaagaaacaaaaacccaaacagtccttcttattcagacttctttgtaaaaccgaccaaaataactctctctttttcttaattgcttgaagtgatactcacattcagttccactagttgtctctaagcagtggtataaccagaataattggagtcccacctgaaagaaaagatggataaatttaactacctta

SEQ ID NO: 56455 - DNA, 359 bp, Homo sapiens
caaggtcatacatgcatcatttcattccgtgctcatgacaactacatgatccaccatctctcccaaacacaggatgaagttaaagttctttatctgcctaaaatccagacccaccaaggagatcttctccatcttattagaccaagatgtaaccacacctgaatggacattttcccaagataatgtctgagttaatccctgctccctgatccattcattctccctcgcaatccctttaacagaattcctcttctctccctgctattttgccaggaaggcatagaagcttctgactctagttggggttttgtggttctccctgtgtatacattaataaagtttgtatgcctttgccctga

SEQ ID NO: 56456 - DNA, 375 bp, Homo sapiens
ccccccgtgtcgctgttccccccgtgtcgctgttccccccgtgtcgctgttccccccgtgtcgctgttccctccgtgtccgtattcctcccgtgtccgtattccttacctgcaccttttcctgcaggtgggactcagggtacttgttcagcacatgtgctttcctcttcgtcttctaggagggagtggttgggtctgggctccctgttcccaagcccacgttgtgttcatggctgtggctgcctgggtgatgagtgtgagtttgcacctgggtttccctgggccttaagcagacagcgtcaccctcagagccatcaccactgtgaatcatttggatctttttccatctgggcataaaattgtatgtgtagacaaa

SEQ ID NO: 56457 - DNA, 635 bp, Homo sapiens
gaatacaggtggggaggagggtgtggcaaatgtgtcaaaaataggaagcaatagaaaaggagctcagtgggtagaaggctaaaagatacaggtggtaagcagtctgtttcagactactttagcacacattaggcaaaagaatttcaaagagcaaggaaaatatgacaaacacaccaagggtcaatcatcaattaattcaatgcaaaaaaggtattgaacacgagtctttgatgcctcttccttcactctaccacctatcctatctaaccaaacccaggttttactcagttctttcttactaatctttcaaatttatctcctcctctacctcttccctaagatactgtactagagactgcagaatatacacaagtttgagggagcaagctctatcattaggacctcccacttgaacagaggaggcaaagacaacataagtatgccaactgaattctttctcttttggcacctaacactttccactttgtattatcttaattcctcatagactctagatctttaaaaatgaggaagactaaaatagacagacgggtgagcactccagggcaaaagtgaccacaaagtaggctcagaggaagggataacagcaagttgttctgtgacaaagagaagat

SEQ ID NO: 56458 - DNA, 323 bp, Homo sapiens
ggcacccccagaatgaagcccagactccaccataatggccctgtatgcccttctatccccttagctgctggtgtgatcatagcctcaaattgctgggctcaagtgatcctcccacctcagcctcccaaagcacagggattacaggtgtgagccaccacgcgcagtctgcaaaataattcttaaacttgaagaggtccctggcaaaaaaagatggatttcatccataggtgacacagcaagaaggccctcaccagatgcagctcctcaatcttggacctcccagcctccagaagcatgagccaaataaatttctgttcattata

SEQ ID NO: 56459 - DNA, 880 bp, Homo sapiens
agatagattataggaattagcttacctgattgcaggggctggcaaatcagaaacctgtagggcaggccagcaggctgagaattctctggcagaagctgaagctacagtccaaaggcaactttttttcttcctcagggaaacctcagttttattattaaggcctttcaactgattggatgacacctacccagattatcaaagatacctcctttaattagacttatctgactatagatgcttacccaactacagaatactttcacagcaacatttagattcatgtttaattggaaactgggtacgatagcctagccaaatttacacataaaaccagtcatcacagtgctccagagagagagagacaaagagaggagaaatttacttatcatcttgagatctaaatgaacagtaagagagacagagtaaaaaagagagagaaacctatcatgttaatatcttaaaaaaagaaaaaatagaggaaaaaaatctttaagaacacttaaccatgtttgttattacatgttttttgagaccagattttatgccatctgtgttaacccccccacataagtctacatcaagtatttggttaaaagtgctcacagcagaatttactgaggatttaatggaagtgttctaaaactggattgttgtaatgcacaactgcacaagtgggtaaatttacaaagaaaaatgtacacataaaatgggtgaactttatggtatataaaaattacagtggtatatagaaattatatgaaaataaaactgctttaaaaagtgacctgaacaacatactatgtttccaaggctgggatgtggtaggtattcttatatgttgctgttctgaatagaagatagtatgacccttgcggatgga

SEQ ID NO: 56460 - DNA, 277 bp, Homo sapiens
aagaaaggttaaactctgtgagttaaacacacacatcactacgcagtgtctgggaacgagtttgtcttgtttttatacgaagatatttccttttctaccattggcatcgaagcgcttgaaatctccacttgcaaattccagaaaaagagtgtttcaaatctgctctgtctaaaggaaggttgaactctgtgagttgcatacacacaacacaaagaagttactgagaaatcttctgtctagcataatatgaagaaatcccgtttccaacgaaggcctc

SEQ ID NO: 56461 - DNA, 266 bp, Homo sapiens
ctgaaaattactcttaaacatggcacataaccatttataaacagttataattatctacctagaaaacactaaaaaataaactcaaaaatgattagagtttataggaaaatttagtcaagtacctagttataaaataaaggaaaaaatcagttattggtcaaaataaaactgaagatgcttataaaataatagtgggtgaaaattctttcataacatagaaatttgtatttattaactttctctaaagatttagtgtgcctagtttt

SEQ ID NO: 56462 - DNA, 322 bp, Homo sapiens
  misc_feature (1)..(3): n is a, c, g, or t
  misc_feature (71)..(72): n is a, c, g, or t
  misc_feature (75)..(75): n is a, c, g, or t
  misc_feature (87)..(87): n is a, c, g, or t
  misc_feature (140)..(140): n is a, c, g, or t
  misc_feature (244)..(244): n is a, c, g, or t
  misc_feature (246)..(246): n is a, c, g, or t
nnngctgtgtgagctgggactggctcgcagccctccgagatggcccagcagtcggacaaggccgtgaagtnntgngccctggagganattcaaagcacaatcatagcaaaagcacctgggtgtacgatttgaccaaattnctggcagagcatcctggtgggaaagaagtcttaagggaataagctggagagatgctactgaaaactttgaggatgtcgggcactctacagatgccagagaattntncaaatcataaatcattggggtttcatctggatgacagataaagttaactaagccttcagaattttttttttttttt

SEQ ID NO: 56463 - DNA, 520 bp, Homo sapiens
ccaaagaaccaaccgtcaacacaaatttcagtctctatgttaagggcagagggaagacaatggggttctgttcaagaggtgaccaaagaccatggacatctgggcaccagcaaggttctgtggaggtttggaacattttggccttgaccaggtcacaatgctcctataaatctttaacaaaacatagttgtttacatatctcccctttaatcccagagttaaattcaaaaaactacatgactgctgtttttatgttttatttcagtgccctaaaattatcctagcctgtgtgcaggaatgggtaaaggctgcttaaacaaaaatggaatttgctgtgttagttctttcgctgtttcactgttacgtcgctagtatcgcctgagagcttgctagaactctcagacccagcccagcatctttagtttatcatgatcctcaggtgatacagatacacattaaagtttgagaagcactgctattctaaaggttctcaatttgcaattcggctaccacctgcatt

SEQ ID NO: 56464 - DNA, 1607 bp, Homo sapiens
ggggaagcagaggggacgatgaggtgcggaggcgttggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggaggacctgatgattgatttagcatctttggcatccggccactgctctgcttggccatactgctgccttcaccctcagctgttgcaactcttttggccactttgtgtaactgccctgccaagccctgcttcctggctgtccaaagaaagaagtgtttcctacaggagatcacaacaaaaggatgaaatctggggtgcaggggaagggtagcttctgaagctggaaaataaagaagtaaggaagggagactgtggaatttaccagggagggaaactaatatttcctttcatataagttggtactattctggctttttaccatgatcatatattatattcaaaataaagctcttgtttttgaaacaaaaaaatataaacaaaggaaggaaggatgttcatttatttagataatagatacctagtgaacccctagtagaccttgtactgggtcctggggacactggtgaccaggttccattcctgatctcctggagcaggggacacgaaaagacattaagcaaataattacacatctttttacatcagtacaaatgttgggactttgcaagagttccaccctgaaagcttctgttttcactgaaagagaggaggcaaggtcatttgttcataaaagcaatggaattgagtaggggacttgaaagaaatgatgaggctaggaaaagcagctataggaaagggggcaccagtcagactaagaatatgtaaccagagcacagctgtgcatactttgcttgaatgtctccaagttcaaatccaagaacttgatattttaggttgattctatgtgtaacctatttgtttttaaagagtagagtctttttcttccagcatgtgttagttagccctgtctttatcacatcaccaccaccaattgtcatttgcagaagtatcttcaactcatcataaatttactagtaatagctaactcatgtctatagaactgttaagtgacaagataatatttagattaaaagctatagttgcattcttattagagacttaatcagattttaacatgctcctcacaggggccatttagccctattctgctgggctttggcaagcactgaatgattgccctcctagggcagaggtactgcagccctggttaagcattgaaaagatgatattaccaataagttgactctaattgtaaacaacatatttaaacaattacatcttaattaaattcttataaattataagtgcctcagaactttctttcttaatctcaaatgcatgtttcttaaaatcattcactattttatgagaatatatttgctgaatattagaaaaaagagttaaaaataaaaggcatttct

SEQ ID NO: 56465 - DNA, 314 bp, Homo sapiens
aaggaagaaaaatcctgctgaatccaggagctcttgctgtcccttttgccctcacatgaaacgtctttgtggctcagactcaatgagctatggacctgtggaccctggtggcagtcacacagtgtcaaggattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56466 - DNA, 357 bp, Homo sapiens
aaggaagaaaaatcctgctgaatccaggagctcttgctgtcccttttgccctcacatgaaacgtctttgtggctcagactcaatgagctatggacctgtggaccctggtggcagtcacacagtgtcaaggagctgagggctgtgccctgccaccgggccacaaagtgtcacagattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56467 - DNA, 286 bp, Homo sapiens
ttctgcatttccatctgaggtaccgggttcatctcactagggagtgccagacagtgggcacaggacagtgggtgcagcgcaccatgcacgagccgaagcaggattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56468 - DNA, 915 bp, Homo sapiens
tctaggagctgtcagattaaacccccagacccacaagaaaatccctgaagcttcgttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttcacaaaaacaaacacaaaacaaaaaaaaaaaaaatttttggggcgccggggccctgggaaaaagtttttaaaccacttgttggggcggccgggccccaatggttatggctacacctgggcccacggccggtacccaagagaaccccggggcctaaaaatggggctgggttcctcccaatataaaaaccggcgcggggacaccgggcgcgtttggacacaacccccgagtgggcgtttaggcgcattcgcgggcttccaacgaggccagcgagctattacgcgccccgctgcggggtgggacaaacagagcagcaagacacaagaagaaggaatagacagaccaccccacaaacacaggagaaacagacaatcggacagaagaccaaaaaaagcagacaaagtaagagacagaacaaaaagacacaaatagcaagcacgacaaaaagacaat

SEQ ID NO: 56469 - DNA, 709 bp, Homo sapiens
ggggaagcagaggggacgatgaggtgcggaggcgttggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggaggacctgatgattgatttagcatctttggcatccggccactgctctgcttggccatactgctgccttcaccctcagctgttgcaactcttttggccactttgtgtaactgccctgccaagccctgcttcctggctgtccaaagaaagaagtgtttcctacaggagatcacaacaaaaggatgaaatctggggtgcaggggaagggtagcttctgaagctggaaaataaagaagcatgctaattgtcaaataaagtgggctgtgttgtaagtagatgtattaaacaaattccaccgttatatgtgtcaatttgcgataattcattggtaataagtgaagaagtaaatatgtgatgaagaaagtccaaaagaactattaaataccatgttaatgaagatatctatgatgttgcaatgctatatcatcttgataccagtaagtaa

SEQ ID NO: 56470 - DNA, 639 bp, Homo sapiens
  misc_feature (624)..(624): n is a, c, g, or t
  misc_feature (639)..(639): n is a, c, g, or t
ggggaagcagaggggacgatgaggtgcggaggcgttggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggaggatatatttggcattaaactcgggacaaaagaagacacaaactttatcttgtggtttgggtcctccaatcctcataaaagtgtggtttcacctgttacctcataaaggtgccattgctgtatgcacatctgaatctgtttacaatttgagaatagagattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttcaaaaaaaaaacaaccnctccaaaaaaaatgn

SEQ ID NO: 56471 - DNA, 303 bp, Homo sapiens
  misc_feature (248)..(248): n is a, c, g, or t
catgtgaaattgaatcccatgagctacacacactactttctgatatttattatcttgctgaagattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttcangatgcggccggaagcctttaattacatcaactgtcagatatcatctctaaacccc

SEQ ID NO: 56472 - DNA, 672 bp, Homo sapiens
gaggtgcggagggtgtggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagacacagagtttcattctgtcacccaggctggagtgcagatgcagtggcatgatgatagtgcactacaacttggaactcctgggctcaagccatcttccctccactgcctccaagtagctggggactacaggtcatgtgagcacacagcataaaggcagctgcccacaagccaggaagagaagcatcatcagaaaccgaccatactggcttcctgatctcagactttcagcctccagaatgattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56473 - DNA, 560 bp, Homo sapiens
gaggtgcggagggtgtggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagacacagagtttcattctgtcacccaggctggagtgcagatgcagtggcatgatgatagtgcactacaacttggaactcctgggctcaagccatcttccctccactgcctccaagtagctggggactacattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56474 - DNA, 507 bp, Homo sapiens
agctgctatgcttggagtgtgactctagagggtcgcctctgaggtcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagaggtcatgtgagcacacagcataaaggcagctgcccacaagccaggaagagaagcatcatcagaaaccgaccatactggcttcctgatctcagactttcagcctccagaatgattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56475 - DNA, 728 bp, Homo sapiens
  misc_feature (673)..(673): n is a, c, g, or t
gaggtgcggagggtgtggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagacacagagtttcattctgtcacccaggctggagtgcagatgcagtggcatgatgatagtgcactacaacttggaactcctgggctcaagccatcttccctccactgcctccaagtagctggggactacaggtcatgtgagcacacagcataaaggcagctgcccacaagccaggaagagaagcatcatcagaaaccgaccatactggcttcctgatctcagactttcagcctccagaatgattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttcangatgcggccggaagcctttaattacatcaactgtcagatatcatctctaaacccc

SEQ ID NO: 56476 - DNA, 243 bp, Homo sapiens
ggttagagtgagggctgtgactgtcctgtcagcccctggattcagcctctttcctaaggattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56477 - DNA, 1715 bp, Homo sapiens
gaggtgcggagggtgtggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagacacagagtttcattctgtcacccaggctggagtgcagatgcagtggcatgatgatagtgcactacaacttggaactcctgggctcaagccatcttccctccactgcctccaagtagctggggactacgacctgatgattgatttagcatctttggcatccggccactgctctgcttggccatactgctgccttcaccctcagctgttgcaactcttttggccactttgtgtaactgccctgccaagccctgcttcctggctgtccaaagaaagaagtgtttcctacaggagatcacaacaaaaggatgaaatctggggtgcaggggaagggtagcttctgaagctggaaaataaagaagtaaggaagggagactgtggaatttaccagggagggaaactaatatttcctttcatataagttggtactattctggctttttaccatgatcatatattatattcaaaataaagctcttgtttttgaaacaaaaaaatataaacaaaggaaggaaggatgttcatttatttagataatagatacctagtgaacccctagtagaccttgtactgggtcctggggacactggtgaccaggttccattcctgatctcctggagcaggggacacgaaaagacattaagcaaataattacacatctttttacatcagtacaaatgttgggactttgcaagagttccaccctgaaagcttctgttttcactgaaagagaggaggcaaggtcatttgttcataaaagcaatggaattgagtaggggacttgaaagaaatgatgaggctaggaaaagcagctataggaaagggggcaccagtcagactaagaatatgtaaccagagcacagctgtgcatactttgcttgaatgtctccaagttcaaatccaagaacttgatattttaggttgattctatgtgtaacctatttgtttttaaagagtagagtctttttcttccagcatgtgttagttagccctgtctttatcacatcaccaccaccaattgtcatttgcagaagtatcttcaactcatcataaatttactagtaatagctaactcatgtctatagaactgttaagtgacaagataatatttagattaaaagctatagttgcattcttattagagacttaatcagattttaacatgctcctcacaggggccatttagccctattctgctgggctttggcaagcactgaatgattgccctcctagggcagaggtactgcagccctggttaagcattgaaaagatgatattaccaataagttgactctaattgtaaacaacatatttaaacaattacatcttaattaaattcttataaattataagtgcctcagaactttctttcttaatctcaaatgcatgtttcttaaaatcattcactattttatgagaatatatttgctgaatattagaaaaaagagttaaaaataaaaggcatttct

SEQ ID NO: 56478 - DNA, 1744 bp, Homo sapiens
gaggtgcggagggtgtggcagttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggaggatatatttggcattaaactcgggacaaaagaagacacaaactttatcttgtggtttgggtcctccaatcctcataaaagtgtggtttcacctgttacctcataaaggtgccattgctgtatgcacatctgaatctgtttacaatttgagaatagaggacctgatgattgatttagcatctttggcatccggccactgctctgcttggccatactgctgccttcaccctcagctgttgcaactcttttggccactttgtgtaactgccctgccaagccctgcttcctggctgtccaaagaaagaagtgtttcctacaggagatcacaacaaaaggatgaaatctggggtgcaggggaagggtagcttctgaagctggaaaataaagaagtaaggaagggagactgtggaatttaccagggagggaaactaatatttcctttcatataagttggtactattctggctttttaccatgatcatatattatattcaaaataaagctcttgtttttgaaacaaaaaaatataaacaaaggaaggaaggatgttcatttatttagataatagatacctagtgaacccctagtagaccttgtactgggtcctggggacactggtgaccaggttccattcctgatctcctggagcaggggacacgaaaagacattaagcaaataattacacatctttttacatcagtacaaatgttgggactttgcaagagttccaccctgaaagcttctgttttcactgaaagagaggaggcaaggtcatttgttcataaaagcaatggaattgagtaggggacttgaaagaaatgatgaggctaggaaaagcagctataggaaagggggcaccagtcagactaagaatatgtaaccagagcacagctgtgcatactttgcttgaatgtctccaagttcaaatccaagaacttgatattttaggttgattctatgtgtaacctatttgtttttaaagagtagagtctttttcttccagcatgtgttagttagccctgtctttatcacatcaccaccaccaattgtcatttgcagaagtatcttcaactcatcataaatttactagtaatagctaactcatgtctatagaactgttaagtgacaagataatatttagattaaaagctatagttgcattcttattagagacttaatcagattttaacatgctcctcacaggggccatttagccctattctgctgggctttggcaagcactgaatgattgccctcctagggcagaggtactgcagccctggttaagcattgaaaagatgatattaccaataagttgactctaattgtaaacaacatatttaaacaattacatcttaattaaattcttataaattataagtgcctcagaactttctttcttaatctcaaatgcatgtttcttaaaatcattcactattttatgagaatatatttgctgaatattagaaaaaagagttaaaaataaaaggcatttct

SEQ ID NO: 56479 - DNA, 471 bp, Homo sapiens
aaggaagaaaaatcctgctgaatccaggagctcttgctgtcccttttgccctcacatgaaacgtctttgtggctcagactcaatgagctatggacctgtggaccctggtggcagtcacacagtgtcaagggatatatttggcattaaactcgggacaaaagaagacacaaactttatcttgtggtttgggtcctccaatcctcataaaagtgtggtttcacctgttacctcataaaggtgccattgctgtatgcacatctgaatctgtttacaatttgagaatagagattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56480 - DNA, 466 bp, Homo sapiens
tctaggagctgtcagattaaacccccagacccacaagaaaatccctgaagcttcgttgacttttgctgatggagcctctctgaagggcaaattcaaagtacagctgggtgctgcagcactgggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttca

SEQ ID NO: 56481 - DNA, 442 bp, Homo sapiens
tggagtctggttgctggagctgtctgtttgccttgtgagccctccccattggcgcaccctaggaccctgctgacactagtttttttgttgttgttgttttgtttttgagacagggtcttgctctgtcacccaggctggagtgcagtggcaccatcatagctcactgcagccttgaactcccccaggctcaagtgactttcccacctcagcctctggagtagctgggatcataggcacgtaccaccacacccagctaatttttttttctagacgtggagtcttgctatgttgcccaggctggtcttgaactcctggactcaagccatcctcccactttggcctcccagagtgctaggattacaggtatgagccaccacaacctgcctggcactactactaaacagtccctggtagtgtaattggaggcgacggcagaaatgcc

SEQ ID NO: 56482 - DNA, 182 bp, Homo sapiens
agagcttgtccccctatggttcctatggagccccagcccctgcagaccagagcccatggaagcatgtccagcacctgccgagcctccttctccttccctccacagtctgcagcagggctgaagctaagggcagagaaaaatatactctgggcttccccagacacccccacccagcacagcca

SEQ ID NO: 56483 - DNA, 441 bp, Homo sapiens
gctactaagatcaataacaaagatattgccagtctgaggttggacaggcagttgctgggcacatgtccttttaaagtagtattttttgtgtaaggttgcaatggcctttgtgcaaggttttgttttttgcagagtctttttcatgatcagggatacaagtgtgagaactctttcttcatggccttccctggctccatttatcagggttttcttaacattagtgtctccattttgattttcacaactttaacaccatattaaatcctcctaaatacttaactctcttttctagcatagttaattgagttcccttaaatattttaaactacaaatttgatatatctgattctttcaaacactgcaagtgcctgccaaggcagacttaaaaatctgatgaataaaatctttctagccatctaagcaatccctaaaactccaaaa

SEQ ID NO: 56484 - DNA, 294 bp, Homo sapiens
gttgtctcaagacccagccactgggaggctcgctctacgcgatttactctggcccttcctgagccatttgtgcttccaggccacattccccaaaccaagtgtgcgtgtcctcgtctgcctcccggggattctggggcacgttagcctcattcaggtccccagtaaagcaccctgctgaacttatccaacccagagtcgcccgggttaatttgagtagagttttttccttgaaattaagaccctcgggccgggcgtggtggttcacaactgtaaatcccagcaacttttgggagg

SEQ ID NO: 56485 - DNA, 631 bp, Homo sapiens
tagcctcatgtagcatctcccacttctttggacctcatgcttaagcctgcatgaacttcatcccctctaatctgtcatgcccgagtacttacctggaactctcttctccacccacccaaggctggttaacacctctttatccttcagtatgcagctaagatggcccctcctccaggaagccttccctgacttccccatcacatccctgacagggtaaggtatctccccatgggctcccatagtaccccacttttattctatcattagcatttttcatacatattgcctgttttctcagtctgggcaaagaacatgtactcctgtgcctgacacaggtcctggcactttgtcagtgctcaataaatattgccatggggattgctcatcactcacagaaggcttctcagaggccgtaacattttggctggactttgtgagactggcgggcatttgccaggttagcagttttcaaccagggtcatatacgcatcgaaatcacccgcgcaactcttcccaaacatggatgtccagccccgcctgagcacactgaatcagaatctccaaggctgagcctgggcaggtatagttttcataggtttcacaggtgattgcaaatgacagcatgggctaa

SEQ ID NO: 56486 - DNA, 547 bp, Homo sapiens
ccctaatttcaattatttgtactaatttcaaatatttgccctattttcagatattttcaaatatttgccctaatttcaaatatttgccctatttcaatactgtgtctcaatgaatagggaggcccaaggagaaggagagagatgcgagaatggccgattggtggagtagtcagaacacacacatatttatcagttgtttgctgtcttatacgggcgtggctcatggcaccctaaaagaatttaaatagtaacatcaaaggttaatcacagatcgccataacagacataataattaaaaagcttgaaacagtgtgagaattagcaatatgtgacagagacatgaagtgagcgcatggtattggaaaaacagcagacagaattcttcaacacagggttaccacaaacctacattaaaaaaacacactatctgcaaagtgcgataaagcaaagcacagtagaacaaggtatgcctatgcacacagtgtagcaatcagagctggctaggttgtacatagaggtaaaattcatttttttgttggctttttct

SEQ ID NO: 56487 - DNA, 611 bp, Homo sapiens
gtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaagatggagtttcgctctttttgcacaggctgaagtgcaatgccgtgatctcggctcactgcaacctccacctcctaggttcaagtgattctactctctcagcctcccaagtagctgggattacaggcgcgtgccacca

SEQ ID NO: 56488 - DNA, 517 bp, Homo sapiens
gtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttca

SEQ ID NO: 56489 - DNA, 299 bp, Homo sapiens
ttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcaga

SEQ ID NO: 56490 - DNA, 792 bp, Homo sapiens
  misc_feature (753)..(753): n is a, c, g, or t
  misc_feature (755)..(756): n is a, c, g, or t
  misc_feature (764)..(764): n is a, c, g, or t
tcttcactagagattgggtggcatctcttttattaattattaacaggccgaaacgtactggacgttaagatgagctgcttgagatgaaatctttctatataatgtgcccacagcaaattttctcttttcccctgtggcttgaggggaatgggatttaatcatttttagaatatgtaattcatataagtaaaagagaggaaacctcccgtgatccgcgctcttaagcacttaaaattatttgggaggaaaaattattaagatttcttatcgacttcttatgttaaaaaatctattctcccccacccccccaaaaaacttttatgctagtcctgcatttcattagccctgtaagtgtgaaacgtcttaaatgccctctgcagttaaagcattttttgtctttaaattataaaattgattttgctatttggaagatgtcaatgccagtctttatccactttgtctaatatactttgtgttgattggaggaaaggcgagaggctgagacattttaaactgctttctcccctaatgaacagtaacgacccaccaaaaaaaaggaaagtacgttttaatattttgatttaaagttgatgtttcctagtacataggcttttgcttttgtaattctacaaagtgaagttccatactgtcccttgcttatagaataataagaatcacacacgctacccccacacttggagtgacctctgtctgccataaaataatagttctactatgtaattttaaatctcnanntatcaaancacacacacacacagacaaagggaaaca

SEQ ID NO: 56491 - DNA, 432 bp, Homo sapiens
tttcctcctatggctgacctcctaattaacatgtgttctctggaaaaacatttcactcaaacaaacttcacctcatgtccctcggtttatatttcccttcacaaacacaggatagataaggaacagtcagagagctcaatctatacaaatacagttatgcatcacttaatgatcaggatacattctgagaaatgtgtcattaggtgattttgtcgtgtgatcacagagcacacttacacaaacctagatgttatagtctattacacacctagggtatactgtatagattattgctcctaggctacaaacctgtacagtatgttactgtagtgaatactggaggcatttgcaacacaatgatatctgtgtacctaaacacagatgtttcatttctttggctctccgatatcctgccagtgcctcacactgggt

SEQ ID NO: 56492 - DNA, 363 bp, Homo sapiens
ttctctttttcttgactgtatgtatctctgaagttttttattttcctttttccttttctcttgtctaaactgatgtttttcttcccttcttttgggaagaaaatactttttttttctattgacgttcattatttaggcattattccattttttttcactttttttctcataagtatatgtttataaatctactttatgtaagcaactttattttctaaagttatatacttttttaattaaataaaatgctcaaggcagcctttctcatattctggggtgcccagcatctatgtcataccttttgtggcctttcaaaattcctatattctgatagtctatctccttatgaatttttgctcaagt

SEQ ID NO: 56493 - DNA, 269 bp, Homo sapiens
gctcccacttccaatccagactagagctgtgaccaccagcccaaaagaacagggtggcactcctgaccagttcagagccagatagccccacattgctcagaccacagtagctcccaagtccaggccagaggaccccacgatagccaatgcccccaagattccagatccatcctccaggggcagctgcttggtccagcttatagtgagctcactccaggacctgacagctcccatggcgacctctccttggatgctcttcccaaagatct

SEQ ID NO: 56494 - DNA, 1060 bp, Homo sapiens
ttttttttcttgagacagggcctcatcctgtcacccaggctggagtgcagtggcatgaacctggttcactgcagccttgacctcctgtgctcaagcagtcctcctgcctcggcctcctgagtagctgggaccataggtgcatgctgccacgcctggctaatttttaaatttttttgtagagacgagatctcactttgttgcccagcctggtctcaaactccaggtcttaagtgatcctccagcttggcctcccaaagtgctgggattacaggcatgagccgttgtgtctggctctaattttcttttgatcattggaattcagggacttttttttccaaccaggatatgccttggtttgtgtttgtatacattaaccctgccttttagtccatgccctttttcagtgttcaggtttaagtattgcttcatttcagaggaagtttcttctgttatttaactatttccttccatcagcaattttctcctccttgtggaacttctagtttttgcaatttaggtctactggatatgtttctcttatgataactgtcattttatatttatgctgtgtctcttgacattatttctttattgatcttccaggttactaattcaggttgcaacagtggttatcctctcctataagtaactgactaaattgtgcaattgggaaatcacattattttagctcagaaattctaattgtgcgttacagttagccctccttacctactagttctgcatctgtggattcaattaactgtggcttaaaaatttaaaaataaaatgaaaatatcaattcaacaattaaaaaataccaataaaagcacaatatagtataacaacagtttacatagcatttacattgtattactataagtaatctagagatgatttaaagtatacggaaagggctgggtgttgtggctcatgcctgtaatcccagcacttttggaggctgaggcaggaggactgtttgagcccaggagatcagtgctgtgatgaaccatgatcatgccactgcactgaagctgggatgacagagcaagacccatttctt

SEQ ID NO: 56495 - DNA, 438 bp, Homo sapiens
gggtcctgagattgtttttacctctgtcctcatcccttctctctggggtcgtggccagatgctccctgctttgggaacattagttatgaagcttgtagggggtttagctccacagggtcagacctgcaggtgcaaacaggccctaggcgaaccccctggaggaaacgttgacattcctgttctgtccagctcacagaacactcttgttcactcccttattgctgtggggaaagacagggaaaaagtgatgggaccactgaggtagtccctggagatgagagagaagggtggcctgtttacatccatcacaggcaggctgggttagggacaacaaagatggtcaggttccaaattttcttgagtcgggactaaagtagcatcttgttagtgtttgctgggttggataaagcagggcttctcaaacctgagtgtgcctca

SEQ ID NO: 56496 - DNA, 521 bp, Homo sapiens
atgttgtccagtttaacatagtcttaagttttcttaaacccaaataatttatgagtagcttattacatctgcagagctaccttattataatagtacatttacatattgtctcttttagagtaaggaccacatgattgctttgctttaatttaccactttttgtattgcatccatataagagtgtcttactagccagatgattccatggcaaatgattctctgggtccaaagatcggaaagtgaaaagcacacagctggaataagcaacaactccactgctagttacagctctccgtaggaccaccaaaacgtattcaagagctctaggattccataagacccagagcaaaatggtgcctctctgtatattattcttaagagtgtgctgggaagtcaatggtccatgggtaggcagggcagctgtaactgggctttttaaaacaaattatgagtttctctctgttgccagtagttaaggaagctgaacttaaaaggtatacttttttccttaaaaaaaaaaa

SEQ ID NO: 56497 - DNA, 1404 bp, Homo sapiens
agcttcttgtcaacattttccactctctacagcaactcttccaaatctttatcgctctctggaggttactttcctcaagcccagtccccacattctcagcacatgacatcacattctactgcagagagaaacaccctcagcttcctgccctctgccctgtcttcctctggtccttcttcctgctaaatgctagccctgccacctactctggcacctgacccccaccagctgcaccctgtgccctctttgccccttatggcccttttccttcagcccaacaccatctccctctcctatcactcctccacccccaaaccaccatttagctcctttctaacaccccaattcctgacacccacggtggtgataataatgcctgccttgtaggatagttgtgaagacagctattcatacatgtttccttcattctctgagacgacctggctcactgtgaacctgacaattcattttctcaggcctctctcccgttactcatttattcattagtcattcatcaaaatactagaagtaacaataatataataatagctaactaatattttaagttctgccctgttctaggcaccatctagacctgccctgtccctcatgtggccactgagcactggacatgtggccactgtgactcaggatctgaattttaaacttcaattcatttaaatttcaaaacaaaagcaatgtaaatattttttcctatcccattaccctgatttgatcattacacattgtatacatatatcaaatatcacacattctccaagagaatatactatgatatagcaataaaaatgcaaaaataaattaaaaataaaattaaaaattcacattaaacacaacgttattgtttcagtaggactacacttcccttggttgaaaattgagtgggctataagtgtaaaatacacagtagactttgaagacttagaaaaaaaacaagaagtgtttttaatgattttctacactgattcattttgaatgatagtatttttaatacaattaaagtattattaaaattaaattctgtttctttttactttttaacatggctaccagaaaatttaagattacatgtgtggcttgcattatatttctattggataaggctgatgaaacattttacttgtattttctgaagccacccccaaaatctcgctaggaaagttcaactattttacaggtgaggaaactgaggctccaagagaccaagtaatttgcccaaggtccaatggtaagtgttggagcctgacttgaatcgaagcagttgacccagagggttctttttttctaagcattttgctcaccaagtgttttgactttaactttgtaaaaatcctactgggtgaggggaaaaaataaaaggaaagaaagaaaaagaaaaaaaaa

SEQ ID NO: 56498 - DNA, 2231 bp, Homo sapiens
ggacgctgacaagatgcatgggtccagagtataaaggaacccaggagcagctgaaggcaggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcagactctcttgtaaccatcactgaagtcaagaaatatggaatatggtatcactgatggtcttctgc

SEQ ID NO: 56499 - DNA, 1834 bp, Homo sapiens
ggacgctgacaagatgcatgggtccagagtataaaggaacccaggagcagctgaaggcaggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgta

SEQ ID NO: 56500 - DNA, 849 bp, Homo sapiens
ggacgctgacaagatgcatgggtccagagtataaaggaacccaggagcagctgaaggcaggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggtgagctccctgtgccagagtactggaggctgttgcctgctgggctagcccctctccaccctgattttgtcctggggagagtaggtggtgctctgcagtaaggagaatagctgagccccaggcctgttctgcctgcaacagcagtgccaaagccctgctctactgacatgtgccgcaggctgccactgagtcggtgccgatgaatagcgaggtgccgatgaatagcgaagtgccgatgatagcgaggtgccgatgataat

SEQ ID NO: 56501 - DNA, 440 bp, Homo sapiens
cctattcactcaaaactcactgacgcactgtggtcctggatggccttgggttggctggggagataaagctggctgaataacacaatgaggtagactttgagtgggaaatggaatactctcagagttttctattagttgcagcctgtgtttatggtcatgcaaactccacgctttctgggtcctactgaacacaaaaaaattctgatcattatctcctcttgtggcactgcacaaagttctgcacaaagaaaggcatgatgcacttgctctctcagtactgactatatgactgagacagctgtcctatcaaatacacacacagtaaataaagaagatgaagacttccaggccgggcgcggtggctcacgcctgtaatcccagcactttgggaggccgaggcgggcggatcacgaggtcaggagatcgagaccatcccagct

SEQ ID NO: 56502 - DNA, 1758 bp, Homo sapiens
ttggggtccattgcaacccgaggcgagactagagttcccaagcgagaagggaagaggcagtgggtgcacgtggaaggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactgcacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacagattttgt

SEQ ID NO: 56503 - DNA, 1386 bp, Homo sapiens
ttggggtccattgcaacccgaggcgagactagagttcccaagcgagaagggaagaggcagtgggtgcacgtggaaggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagtgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacagattttgt

SEQ ID NO: 56504 - DNA, 1440 bp, Homo sapiens
ttggggtccattgcaacccgaggcgagactagagttcccaagcgagaagggaagaggcagtgggtgcacgtggaaggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacagattttgt

SEQ ID NO: 56505 - DNA, 294 bp, Homo sapiens
acaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgacc

SEQ ID NO: 56506 - DNA, 249 bp, Homo sapiens
cacccccagaagttctgattcagtgggtggcgggtgaggcctgggaacttcatgacgagccccctggcaaggctgctgctgccattttggtgccacactttgggtactatggctttgggcactcccaatccaggtgccatggcatggggagcagtgggtgaaccaaatcctggagcctggactgttccattgggtgcatttctggctggcagatagaggaccacccagctgtgcttgatggggtctaga

SEQ ID NO: 56507 - DNA, 363 bp, Homo sapiens
gaaaacccaggcataaataacaagtcatggtaataatttgtattattcattggttatagcactcttcagctgtaattcattatgcctcttctttagatattgatggtaaaaacaaatgcgataccattcctacaagacatagtcgcccatcataaagaattatatttgtggaaaagacttcaagaaattacaagataggcatctgcagtggagttgaaacaccacactgcccaggacaggcacactgggtcattttctaaccattgagagtatgggtacaaaaataaatatacacatgcagtgttccttctttcactaactacatgctgcacctgtgcacacatagatctgatgacatcttct

SEQ ID NO: 56508 - DNA, 183 bp, Homo sapiens
aattgaattcttaagaagctgtcaaatatggcagtcttttgatgttagtaattttgttttcttctgtgttattggttcaaagtactggccttttccttcatttccagtaattagttgttatagactatcactttttaatgtgagtggaaattagatgatttggttatacttgtgaaaacatgc

SEQ ID NO: 56509 - DNA, 431 bp, Homo sapiens
cctggcgtggtggtgcatgcttgtaatcccagctacttgggaagctaaggtaggaaaatcacttgaacccaggaggcggaggtttggatgagccaaaatagtgccagtgcactccagcccgggcaacaagagacaaactctgtctcaaaaaagaaaaaaaaaaaaaaaagaaaagaaaacggttaagtaattatcagcataatttttatatagctaggtgtcataactgtatttttaattttaccacacaatgttatccttagctgtacctattaggaaggctcagtatccaacacattagtaaaaagctaaagtaatattcaaagctgtagagaaacttaacagcaaggattgagagcataccctcagactgctaccttgttcacatttttactaccattaatctgatacattgctgtgctccacagtgc

SEQ ID NO: 56510 - DNA, 2937 bp, Homo sapiens
ccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcgccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttttgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattatgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtattgcatagccttgctttcttgaactaaactgtttgcccttcacaagtagttcttctttcaggattagttcgttccaaggaggctcttcagtctcacagataagtagatctctcctgctgtctggacacatttcactcggaaattgaatacaatttgtattcaggctgggaacctgaacacacacttgtgtttttaagcttcccttttttacagtggacaaggacacaaataataaataaatcatccctaatgcccaagaaatgccctggtacttagtaataacaaaataccagtaacttccagttgtttctcactaccttttttcttgagtaggatgataatagaattacaactcttgagggcaacataaatataggtggatatttgtggtatgatat

SEQ ID NO: 56511 - DNA, 2795 bp, Homo sapiens
ccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcgccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttttgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattatgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtattgcatagccttgctttcttgaactaaactgtttgcccttcacaagtagttcttctttcaggattagttcgttccaaggaggctcttcagtctcacagataagtagatctctcctgctgtctggacacatttcactcggaaattgaatacaatttgtattcaggctgggaacctgaacacacacttgtgtttttaagcttcccttttttacagtggacaaggacacaaataataaataaatcatccctaatgccca

SEQ ID NO: 56512 - DNA, 2123 bp, Homo sapiens
ccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcgccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttttgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattatgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctga

SEQ ID NO: 56513 - DNA, 2540 bp, Homo sapiens
ccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcgccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttttgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattatgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtat

SEQ ID NO: 56514 - DNA, 2226 bp, Homo sapiens
ccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttttgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattatgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtat

SEQ ID NO: 56515 - DNA, 2226 bp, Homo sapiens
tgatgagaatccaagctgcaaactgggcggcttgggcaactgttttcttaaccaccctccacgttgtggcttacgtcttttagcaccgccctcagggcaaaggatggtggtcagaggtaactaccacagtaaaagaaggctatttatgtggtctgtttacagttacccggtttcaacactaagccagctttccgccacgtctcgggcgaacctccggcctgaggtcacagagacgcccgggtggctctcaggagccagcatggcagcctcctcaggacgggtactcaggaatttcgcccgcagggactaacaccacttggacccaggaactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttg

SEQ ID NO: 56516 - DNA, 2262 bp, Homo sapiens
tgatgagaatccaagctgcaaactgggcggcttgggcaactgttttcttaaccaccctccacgttgtggcttacgtcttttagcaccgccctcagggcaaaggatggtggtcagaggtaactaccacagtaaaagaaggctatttatgtggtctgtttacagttacccggtttcaacactaagccagctttccgccacgtctcgggcgaacctccggcctgaggtcacagagacgcccgggtggctctcaggagccagcatggcagcctcctcaggacgggtactcaggaatttcgcccgcagggactaacaccacttggacccaggaactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacagttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttg

SEQ ID NO: 56517 - DNA, 2095 bp, Homo sapiens
  misc_feature (1493)..(1493): n is a, c, g, or t
  misc_feature (1571)..(1571): n is a, c, g, or t
  misc_feature (1593)..(1593): n is a, c, g, or t
  misc_feature (1719)..(1719): n is a, c, g, or t
  misc_feature (1758)..(1758): n is a, c, g, or t
  misc_feature (1762)..(1762): n is a, c, g, or t
  misc_feature (1767)..(1767): n is a, c, g, or t
  misc_feature (1771)..(1771): n is a, c, g, or t
  misc_feature (1775)..(1776): n is a, c, g, or t
  misc_feature (1796)..(1796): n is a, c, g, or t
  misc_feature (1811)..(1811): n is a, c, g, or t
  misc_feature (1822)..(1824): n is a, c, g, or t
  misc_feature (1840)..(1841): n is a, c, g, or t
  misc_feature (1844)..(1845): n is a, c, g, or t
  misc_feature (1850)..(1850): n is a, c, g, or t
  misc_feature (1854)..(1854): n is a, c, g, or t
  misc_feature (1857)..(1857): n is a, c, g, or t
  misc_feature (1906)..(1906): n is a, c, g, or t
  misc_feature (1915)..(1915): n is a, c, g, or t
  misc_feature (1993)..(1993): n is a, c, g, or t
  misc_feature (2090)..(2090): n is a, c, g, or t
tgatgagaatccaagctgcaaactgggcggcttgggcaactgttttcttaaccaccctccacgttgtggcttacgtcttttagcaccgccctcagggcaaaggatggtggtcagaggtaactaccacagtaaaagaaggctatttatgtggtctgtttacagttacccggtttcaacactaagccagctttccgccacgtctcgggcgaacctccggcctgaggtcacagagacgcccgggtggctctcaggagccagcatggcagcctcctcaggacgggtactcaggaatttcgcccgcagggactaacaccacttggacccaggaactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcggtgagctgggtctgtctggggctgtccacagttgggcggtaaaagagatacggcttatgaatttgaaaggcatgtaagtaatttataatatgacttataaattaggaaggcaaccgaaagatgtttctacactgtaattcttgcagcacagctttgtatcggatggtccagtgatcgtatttcttttgataagcaggactggaaggagccgtttgtccagcttgccatttagatttggcctgaaattcaggtgattttgacaaatttgcaattaaaaatcgaaggtcataacttttttgagttacctttagcagcataaattttaaagatgtagtacggagtcagcttaaaaaatattaagggtctgataacttgactagaattaagattgtttccagtagctgtatgaatagttattgagtacctactatatgccaaatacgtgctcgtatatatcatgtgtattacatgtattgtctcatctaatcctaacaacaaccctagtctgaaccgaattctcattttttcccaaagtgctgggattacaggcatgagtcaccgtgtcctgcccagacatatcaaatttgacaggtattgtataccctttggatctttaggaattaacttttgcctctgtcactcagctttgtatattcngaaatggagataagtatagggaggtcttggaaggaaaattgccagaattcccaaaccatgtaacactcattgagaatnccagacccattatatctaaagngcaagtgaaggaaacagtattgtgaactgggtataaccccttggttcttaactagtacattcttaatctgtgagacccaaaggttgataaacaataatttaagattgtacagtactctaaacgtcngcaaaggtctagatgttatcagtatcactagtttttatncctnccagnagcncccnnttaggttacattgttgtccnctttccagtgtggcntctgtcattgnnnttccactatggcaagnncannaaaangctngcnccattgttatcttcaagtaatgcccataaggagatggaagatatctganacaattaangctttagcttctaggcaagagaaataacgttgcattaaatttcaagtttctttctgctagacttgaatgtgtctagcnactctaatttatgggggcttttggttttttcctattgtactttgtatgtagaattgttttgaaatatcaagcatatttactttgaatttgaactctntctta

SEQ ID NO: 56518 - DNA, 2358 bp, Homo sapiens
tgatgagaatccaagctgcaaactgggcggcttgggcaactgttttcttaaccaccctccacgttgtggcttacgtcttttagcaccgccctcagggcaaaggatggtggtcagaggtaactaccacagtaaaagaaggctatttatgtggtctgtttacagttacccggtttcaacactaagccagctttccgccacgtctcgggcgaacctccggcctgaggtcacagagacgcccgggtggctctcaggagccagcatggcagcctcctcaggacgggtactcaggaatttcgcccgcagggactaacaccacttggacccaggaactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttg

SEQ ID NO: 56519 - DNA, 2318 bp, Homo sapiens
tgatgagaatccaagctgcaaactgggcggcttgggcaactgttttcttaaccaccctccacgttgtggcttacgtcttttagcaccgccctcagggcaaaggatggtggtcagaggtaactaccacagtaaaagaaggctatttatgtggtctgtttacagttacccggtttcaacactaagccagctttccgccacgtctcgggcgaacctccggcctgaggtcacagagacgcccgggtggctctcaggagccagcatggcagcctcctcaggacgggtactcaggaatttcgcccgcagggactaacaccacttggacccaggaactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttg

SEQ ID NO: 56520 - DNA, 1638 bp, Homo sapiens
tgatgagaatccaagctgcaaactgggcggcttgggcaactgttttcttaaccaccctccacgttgtggcttacgtcttttagcaccgccctcagggcaaaggatggtggtcagaggtaactaccacagtaaaagaaggctatttatgtggtctgtttacagttacccggtttcaacactaagccagctttccgccacgtctcgggcgaacctccggcctgaggtcacagagacgcccgggtggctctcaggagccagcatggcagcctcctcaggacgggtactcaggaatttcgcccgcagggactaacaccacttggacccaggaactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttggagaaaggtattatctaggtgccttatcacagatagtgtgacgtatgtcagtgacagatgcacttatataggcacttaatgtagattctagactaagtatacttgcaagctgagtcgagctgtactcgatatgcttgctattagagacaagctgataga

SEQ ID NO: 56521 - DNA, 476 bp, Homo sapiens
aattgcgatcttggttggactgacttatcatctgtaagaaatgtcttgattttctacactatcttgactaatttctcctggagttccattcaattatgcccctcttatttcagactatttgtttatgagtacaatatttcctggagtattgaacccttatcatttgaaagttaccctcccagttttcacagtaagtttttattatcaggaaaagaagctgctttcatgttggaaaaagaatcaccatgagtaatgaccagagtattttcagatcaacatcatcatcatccatttactttaagtaccatttgttatttcatttaatccttacaatgactttacaaggtaagaactcttgccaacaatattattttcagtttgtagacaagaaaggtggggtctagaaagttaggtaccctaaccttctcaggattacagagtaagtgctagaaccagaattaaacctcagttgaccc

SEQ ID NO: 56522 - DNA, 388 bp, Homo sapiens
agttttccaagattgagtgacactattgtaatgagaatcttcactggagcatcagaagaactgatttcaagccagttttgttggtcagcacggtcaaaacttcagaagaatcttgtgctctgaggctttccaaagctttgttccccagggcagtaacagcttccagtgttggcagagtctttagtattatcaccagggcagctgcactgtggcctgtagccatctttctcttttagtacgatcccacctgtcagacttcttgaatttgcacttcaaattagagccacaatcaaattatcagtcacgttgtttatttttgtcaccagagaaaggacagagtcctgttcagcagagttgggagccaggtactgatctctcttcagcaagg

SEQ ID NO: 56523 - DNA, 639 bp, Homo sapiens
ttgtgataaggtttgtgaaaagaaaatttatgaaaggaaatttgcatgtgatcaggttggctataattaaaggaaattacttataagtctttctaaagattgagctttgatattaaattatactaatacaaaactaaaattttggttccctatgttagaataaagcaagtttttcatcaactatcaatttgcttttagtaaaattcagaggttctgaatttttaattctgaaatctgtatcttttaaaacttctcagacttatatctcgggaagttccaacttttactgtaccttgctgcatgtgatttgcaggtcacatgtgattgccttctgttttttaatccctgggaaaggtacatctttttgcttggctgggatggtaactctgtccttcaatgtttttatcaattcctgtaacttttgttctggttctaacactgatgttgtggcctgacactgaaatgttttatcttgaaggtgtagaaaagcaatgttttccttcagtataacttgattctgtactcttgggttttctttataggtctgcattgttcagtataaccaggaaacatccatgttgttactaagagtccctactttgtgtccctacacaaggtactagttttcttgtttacatt

SEQ ID NO: 56524 - DNA, 2873 bp, Homo sapiens
ccactctaaggaatgcggtccctttgacaggcgaaaaactgaagttggaaaagacaaagtgatttgttcaaaattgaaatttgaaacttgacatttggtcagtgggccctatgtaggaaaaaacctccaagagagctagggttcctctcagagaggaaagacaggtccttaggtcctcaccctcccgtctccttgcccttgcagttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcaca

SEQ ID NO: 56525 - DNA, 878 bp, Homo sapiens
ggtttcctgagtgatgtcggcctgtgtaaggcccgcggggcctccccccgagtcctcgagaagtcgtgggcgaaggcgtcgagattccctgcccttagggggaatccgctctccgggtggcccgtgtctagacccctgctacacgtattcggagtagctcttcccttcggctgcgccctgcgcttttgtccccggccctttgtgttgcgcccctatgtcacggctttttttcggagaccctctttgggccccgggaccggaccttctctggttccggccattgtgtaaggcgaattcgggccttgggcgggcccccgatcggggggaataatttcgaatttttttttttttttttttgtgtgacttctatcaaaacacagaaatacagcacacgcacaaaccagcacaaaagcgcagcgctctatttacagctccggctggcacctgcccacctggccagccgcctgcagggaggggtgggagaggggtcagccacatcagcagggaaaggatacgaagcaggtaaagacagaaggaaaatgggcgggtgcggagaaaccaagagggaggtggagctccagcaatgcggacacgaggagacaggagcagaaggggctgggggagacctgacctgtccttcctctctccccccagattcccatccaggactccaaaagcatagctgaagggggtgtggcgggtgcagggatgcacggaaagaggtaaaatagagaggctccataggaattgggaggagtgggggaggggcagtcctggtggccgaaatggaaccaaccccaatgcaaaatcccccaccccacactgccacttccccctaagctgccagcacatctggtttccacaaatgccactccctc

SEQ ID NO: 56526 - DNA, 4861 bp, Homo sapiens
ccactctaaggaatgcggtccctttgacaggcgaaaaactgaagttggaaaagacaaagtgatttgttcaaaattgaaatttgaaacttgacatttggtcagtgggccctatgtaggaaaaaacctccaagagagctagggttcctctcagagaggaaagacaggtccttaggtcctcaccctcccgtctccttgcccttgcagttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtatttatatatttatatttatatatatatttatataatggtacaaaatggctgggggtgtggccatggatggagggaagagtaggctggcctgtggcgcgggtgggaggagaggggacggagagggcactcggcccgctgcaatctgacccctctctcctcagggcaggaaacacagagtcagacagtttgggggggtcttgggccaggggtggagggctcaagggcacagggcccaggctgaggcagggcgggcaaagcgcctggcaggatgaagggcaagtggccccccaaacacagaggccctggccatggaccctgggaggtgaccggggtgagtcaggggcctgttgtcagccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagccataacttgaagaaggggggaagggtttcttttatccttttttttttgtgtgacttctatcaaaacacagaaatacagcacacgcacaaaccagcacaaaagcgcagcgctctatttacagctccggctggcacctgcccacctggccagccgcctgcagggaggggtgggagaggggtcagccacatcagcagggaaaggatacgaagcaggtaaagacagaaggaaaatgggcgggtgcggagaaaccaagagggaggtggagctccagcaatgcggacacgaggagacaggagcagaaggggctgggggagacctgacctgtccttcctctctccccccagattcccatccaggactccaaaagcatagctgaagggggtgtggcgggtgcagggatgcacggaaagaggtaaaatagagaggctccataggaattgggaggagtgggggaggggcagtcctggtggccgaaatggaaccaaccccaatgcaaaatcccccaccccacatatttggagttgttttaccc

SEQ ID NO: 56527 - DNA, 1878 bp, Homo sapiens
  misc_feature (48)..(48): n is a, c, g, or t
aaatttaaaaggttaaggacagattacggggaactccctggcaggaanctcagaaatgatctcggcagtgacgccattggcttgagaatgggatgtgggaatggcagggcgggcaaagcgcctggcaggatgaagggcaagtggccccccaaacacagaggccctggccatggaccctgggaggtgaccggggtgagtcaggggcctgttgtcagccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagccataacttgaagaaggggggaagggtttcttttatccttttttttttgtgtgacttctatcaaaacacagaaatacagcacacgcacaaaccagcacaaaagcgcagcgctctatttacagctccggctggcacctgcccacctggccagccgcctgcagggaggggtgggagaggggtcagccacatcagcagggaaaggatacgaagcaggtaaagacagaaggaaaatgggcgggtgcggagaaaccaagagggaggtggagctccagcaatgcggacacgaggagacaggagcagaaggggctgggggagacctgacctgtccttcctctctccccccagattcccatccaggactccaaaagcatagctgaagggggtgtggcgggtgcagggatgcacggaaagaggtaaaatagagaggctccataggaattgggaggagtgggggaggggcagtcctggtggccgaaatggaaccaaccccaatgcaaaatcccccaccccacactgccacttccccctaagctgccagcacatctggtttccacaaatgccactccctc

SEQ ID NO: 56528 - DNA, 2810 bp, Homo sapiens
ctgacggctgccacctctctagaggcacctggcggggagcctctcaacataagacagtgaccagtctggtgactcacagccggcacagccatgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcaca

SEQ ID NO: 56529 - DNA, 4897 bp, Homo sapiens
ccactctaaggaatgcggtccctttgacaggcgaaaaactgaagttggaaaagacaaagtgatttgttcaaaattgaaatttgaaacttgacatttggtcagtgggccctatgtaggaaaaaacctccaagagagctagggttcctctcagagaggaaagacaggtccttaggtcctcaccctcccgtctccttgcccttgcagttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtatttatatatttatatttatatatatatttatataatggtacaaaatggctgggggtgtggccatggatggagggaagagtaggctggcctgtggcgcgggtgggaggagaggggacggagagggcactcggcccgctgcaatctgacccctctctcctcagggcaggaaacacagagtcagacagtttgggggggtcttgggccaggggtggagggctcaagggcacagggcccaggctgaggcagggcgggcaaagcgcctggcaggatgaagggcaagtggccccccaaacacagaggccctggccatggaccctgggaggtgaccggggtgagtcaggggcctgttgtcagccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagccataacttgaagaaggggggaagggtttcttttatccttttttttttgtgtgacttctatcaaaacacagaaatacagcacacgcacaaaccagcacaaaagcgcagcgctctatttacagctccggctggcacctgcccacctggccagccgcctgcagggaggggtgggagaggggtcagccacatcagcagggaaaggatacgaagcaggtaaagacagaaggaaaatgggcgggtgcggagaaaccaagagggaggtggagctccagcaatgcggacacgaggagacaggagcagaaggggctgggggagacctgacctgtccttcctctctccccccagattcccatccaggactccaaaagcatagctgaagggggtgtggcgggtgcagggatgcacggaaagaggtaaaatagagaggctccataggaattgggaggagtgggggaggggcagtcctggtggccgaaatggaaccaaccccaatgcaaaatcccccaccccacactgccacttccccctaagctgccagcacatctggtttccacaaatgccactccctc

SEQ ID NO: 56530 - DNA, 1688 bp, Homo sapiens
tcgacccctgactcaccccggtcacccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagccataacttgaagaaggggggaagggtttcttttatccttttttttttgtgtgacttctatcaaaacacagaaatacagcacacgcacaaaccagcacaaaagcgcagcgctctatttacagctccggctggcacctgcccacctggccagccgcctgcagggaggggtgggagaggggtcagccacatcagcagggaaaggatacgaagcaggtaaagacagaaggaaaatgggcgggtgcggagaaaccaagagggaggtggagctccagcaatgcggacacgaggagacaggagcagaaggggctgggggagacctgacctgtccttcctctctccccccagattcccatccaggactccaaaagcatagctgaagggggtgtggcgggtgcagggatgcacggaaagaggtaaaatagagaggctccataggaattgggaggagtgggggaggggcagtcctggtggccgaaatggaaccaaccccaatgcaaaatcccccaccccacactgccacttccccctaagctgccagcacatctggtttccacaaatgccactccctc

SEQ ID NO: 56531 - DNA, 192 bp, Homo sapiens
acttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggctttt

SEQ ID NO: 56532 - DNA, 325 bp, Homo sapiens
gattgtgaagggtctttaggctgaactacaaattagcacaaaatatatagataaatagtatgtgtcttaaccagaaggatttagtttgacagataagttttactagacgctgtggaaggtgcatggaagtttaagaaatggttcctcaccttgtgccaagtatagtctggttggagagataaacatgtaacatttagtgacaatactagatacatttgttaagtgttgttggagttcagaggaggcaaaggccactgtgtattggtgtgattgaagaagccctctcagaggaggtaagatttaaatgttcttttaatactaccta

SEQ ID NO: 56533 - DNA, 308 bp, Homo sapiens
cataagacaacccgtagagctctttactttgtatatttaggacagttcaaaataaggcttttgaggcttcaacacactccagaaaatccacccaaaactgcacgttttaggttcacagtagattagtttgtcttagagagagaaacattactctccttaacaaggtggaaatttttatttgatttttttcttgatggcctttttcttttggaattttggtcttttaaagaaattaagtatgattttaaaaatctttggtgcctcagctagtttaattttaatacaattaattctggggaaaataattg

SEQ ID NO: 56534 - DNA, 509 bp, Homo sapiens
gcacgatctcagcgcactgcaagctccgcctgccgggttcacgtcattctcctgcctcagcctcctaagtagctgggactacaggcgcccgccatgacgcctggctaactttttgtatttttagtagagacagggtttcactgtgttagccaggatggtctcaatctcctgacctcatgatctgcccgccttggtctcccaaagtgctgggaatacaggtgtgagccactgcacccggccaaaaaaaattgtttttaagtatgattcaggctgaggtgggtggatcacttgagctcaggagttcaagaccagtctgagcaacatggccaaacgccatctctacaaaaaatacaaaacttagccaggtgtggtggtgggcacctgtagtccccagctacttggaagactgaggtggggggatggcttatgcccagggggtggaggttatagtgagccgtgatcatgccactccaccatgtcagtctgggtgacaaggcagaccctgtctc

SEQ ID NO: 56535 - DNA, 4237 bp, Homo sapiens
  misc_feature (2562)..(2562): n is a, c, g, or t
  misc_feature (2898)..(2898): n is a, c, g, or t
  misc_feature (4236)..(4236): n is a, c, g, or t
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaaggctgccagccacctcctgggctccaccatggtcgtcatacaggtggaaatacggtcttctttgtctctgggatgactgtagactacacttgtgaccctggctatttgcttgtgggaaacaaatccattcactgtatgccttcaggaaattggagtccttctgccccacggtgtgaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggnatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatnaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacana

SEQ ID NO: 56536 - DNA, 4223 bp, Homo sapiens
  misc_feature (2548)..(2548): n is a, c, g, or t
  misc_feature (2884)..(2884): n is a, c, g, or t
  misc_feature (4222)..(4222): n is a, c, g, or t
acacagctattgaatgaccgtggggagttgaaactaggtccactgagctcaaatttccctaatccatggtacctccccacatgtaactatcatgccactaatatgttattttcatgtgctgaatttgccttttgtttcattattaaaattgattagactcagaacttttggatatattcttttcattattattgtttggtcaagatgatttatgttgatctgtttgctgaggatgaagaaaaaggtaagaatttaggagtttgggagtaagcagggaataaataaactatacatatttctaagtctgtttctgaaaaagttatgtgatctatatttggatattttacctacatttgaatattttctcaccatgatcagtatgcctaccaagttccttttctacttttcagggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggnatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatnaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacana

SEQ ID NO: 56537 - DNA, 2753 bp, Homo sapiens
  misc_feature (1078)..(1078): n is a, c, g, or t
  misc_feature (1414)..(1414): n is a, c, g, or t
  misc_feature (2752)..(2752): n is a, c, g, or t
tagaggatcccctcacgatgtgggttcgctggtcgtgtctgacgtggggattccgatgtcatgccgtgctacattggcagccactggccccaatgtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggnatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatnaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacana

SEQ ID NO: 56538 - DNA, 538 bp, Homo sapiens
gtatcgactgcaaggcccaccttctagtcggtgtgtaattgctggacagggagttgcttggaccaaaatgccagtatgtgaaggtaggctaggcaactatggtctgacagcactgcattctcagcttaactaaaagcttttggttcagtcattaccttacagactcttactgaacacagaactcctagagatctttaaggatatgtgcttcaccaaagcatccttattttttgtttcctcaagtaaaatggggttcctaggctttccctcctctgaaagctatgcagaccttctaagtaggtagaccatatgcataaagaaaatagtgtatttggtaaaagaaatcaaaggatcagcagagtacatatactcaggaatgaagcttgagaatcaatcttctaaattatgttgctttagctgccttgactgattcattatagactcggatatcactgtcctaggatagtggtatcaagcagcatctggggcattctttgttttcaatacacctatgatcttgtcatttctttctgcaatt

SEQ ID NO: 56539 - DNA, 4060 bp, Homo sapiens
  misc_feature (2385)..(2385): n is a, c, g, or t
  misc_feature (2721)..(2721): n is a, c, g, or t
  misc_feature (4059)..(4059): n is a, c, g, or t
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggnatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatnaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacana

SEQ ID NO: 56540 - DNA, 3456 bp, Homo sapiens
  misc_feature (1781)..(1781): n is a, c, g, or t
  misc_feature (2117)..(2117): n is a, c, g, or t
  misc_feature (3455)..(3455): n is a, c, g, or t
gcttttttttcctggtatgtgtgtgtaaagttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggnatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatnaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacana

SEQ ID NO: 56541 - DNA, 4914 bp, Homo sapiens
gagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttctgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaa

SEQ ID NO: 56542 - DNA, 3065 bp, Homo sapiens
gagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttctgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaaaaaagaaaaagacaaacacaaataaaatatctgagcggaa

SEQ ID NO: 56543 - DNA, 550 bp, Homo sapiens
gagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaaaagaaaaagacaaacacaaataaaatatctgagcggaa

SEQ ID NO: 56544 - DNA, 3330 bp, Homo sapiens
aggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttctgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaa

SEQ ID NO: 56545 - DNA, 3554 bp, Homo sapiens
gagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttctgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaatctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcggtgaggcctggggtccagggagggagtgcgctagaggccaggctctgtactttgctttagagaaatggacggtgcagggcatgcacagagctggggcttttttacttgggaaactcacatactctccctctgttcgtgttctccacaatgatttatttcatattctcctcagtggttttattctttctcttagtattttcttaaggtcttgacaaagccatgtgcctattcccaagaaccaccaaggaaaagagtggctattatttttttcctgggcctgagttagttaactggctggatcctctgaacgcagcca

SEQ ID NO: 56546 - DNA, 1523 bp, Homo sapiens
ggagttgcgtgaacctgggaggtggaggtgacacgtgagcctgggatcacaccactgcactccagcctggcaacagatgagtgctgggggtgttggagggaggctggagaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaa

SEQ ID NO: 56547 - DNA, 361 bp, Homo sapiens
tgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctag

SEQ ID NO: 56548 - DNA, 4648 bp, Homo sapiens
gagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttctgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaatctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcgctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgatagatgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacagatctcaggactca

SEQ ID NO: 56549 - DNA, 4775 bp, Homo sapiens
ctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttctgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaa

SEQ ID NO: 56550 - DNA, 2173 bp, Homo sapiens
tcacgggaacgcgaccgcgcgccgggacagaagcggcgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaa

SEQ ID NO: 56551 - DNA, 3429 bp, Homo sapiens
gagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttctgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatgagcggtgacaatcatgtggaccgctat

SEQ ID NO: 56552 - DNA, 1712 bp, Homo sapiens
cccctggttgttcctcctcttcctcttcctcctcttcctcctcctcttccccgctgcccccatctccccttgatccgtccactgcatagtctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcgctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgatagatgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacagatctcaggactca

SEQ ID NO: 56553 - DNA, 358 bp, Homo sapiens
gttaatctgttatggttcagccccatttctaaaatgggaataactgtagtctttagctaatgaggctactgagaaaaactaagataatgcctccaaaacatgtttcataatacctgtaaggtagagctcaaaagttagcagctattatgtatttttccaacatgtttgattgctgcttctgctcccctgttattgtttggtatacttcatttccagtgatggctggtcactgatgctgaggagccaggcagctagttttaacgtggttgtagctgcctctgttagttaaagctctatgaatgtcacttaagaagagtcctcaaatacggctgtatctttaagacagaacttaacgtgg

SEQ ID NO: 56554 - DNA, 440 bp, Homo sapiens
aaacccaaacaaaagaggctggttggtcttgaggaacttggaaactagactactctacagcctgttaactggtcctcactacccaggaaaagccctcttgttagtaatcggacaattagaacaaccagattctacctctgcctgccttagacagttttggagacagcacacccagttctctttttcttcttctctctccctcctcctcctttttcagaccccatgatgatatgccacttttgtctgggtttttcacttcagagttttttaaaacagatttccctaaccatattgaatcctggagactctttaattgacactgattggtgacagctagtgaggagggagatttcagaacaagaaagtaatgtgtcttgacctagtgtcctctccttttcctggtccccatttcttacttcttgatcctgtctcacttttgc

SEQ ID NO: 56555 - DNA, 639 bp, Homo sapiens
gtcccgttgctggaaggctttcgttaagtacgtgttcagaatttccatgcagaccttgaaagaagagaacacgctcagttatactgaaacccaccaagctgttcacattctgatacttttctgaaaaggctgctgggaacggtgcaaccctgctgtggttgaacccggaggaaagtcgggaggaagtgggccgcctaaggaagccatttccaaggagaagcagccactgtcacctggaagtcagactcattgaagtcatagtacacgttccagccaatcttcccaaacttccttctctcctgcaccacagcatgaaagaacgccagcacgtagaccacctcatcactcactgccatggcctgctggctacaagggcacatctgagctgcagccccacacgctccgcctggcttcgtaccccatgctagagctacattgtccagtgcgatggccgtgaggcacagcacttaaaatgtggctagccccaattgagatgtgctgtaagtgtgaattcacacaggattttgtagacttaataccagaaaaaagcatgtaaaatgtctcaatcatgttcatattgattatacattcaaatgataattttaatatattcatttaaataaaatgttattacaatta

SEQ ID NO: 56556 - DNA, 439 bp, Homo sapiens
gtcccgttgctggaaggctttcgttaagtacgtgttcagaatttccatgcagaccttgaaagaagagaacacgctcagttatactgaaacccaccaagctgttcacattctgatacttttctgaaaaggctgctgggaacggtgcaaccctgctgtggttgaacccggaggaaagtcgggaggaagtgggccgcctaaggaagccatttccaaggagaagcagccactgtcacctggaagtcagactcattgaagtcatagtacacgttccagccaatcttcccaaacttccttctctcctgcaccacagcatgaaagaacgccagcacgtagaccagcggcttgaaggcagggtgcgggcactggtccagcatttcgtgagagatcttgaagtaagtggtgttacaggcgtttgaagggtgttgcaggcgtttgaagg

SEQ ID NO: 56557 - DNA, 444 bp, Homo sapiens
caaccctgctgtggttgaacccggaggaaagtcgggaggaagtgggccgcctaaggaagccatttccaaggagaagcagccactgtcacctggaagtcagactcattgaagtcatagtacacgttccagccaatcttcccaaacttccttctctcctgcaccacagcatgaaagaacgccagcacgtagaccagcggcttgaaggcagggtgcgggcactggtccagcatttcgtgagagatcttgaagtaagttgccctcatgttgagtttcagcccattgggtggctcggtgacaaccttcagaagagaagaaaacacacagtgatggagaccgcaggcccacaagcttggaagagtgtgcacaatgcaggcactgcgctttccttcctctctacggagccatctgtctgagacctccaatagctaaagtctcttgtccagg

SEQ ID NO: 56558 - DNA, 398 bp, Homo sapiens
tcaccctcgcccaataaactaaatactgttttatcctcactttcagaggagaaaatgggggtacagagaaagaagttaaatagcttgttcaaattaagacatattaaatggcagaactggggctttaattcaaacctctgattccagagcctgtgctcctacctttctttttatccagctcatcccaggctaagagtaaaccaggtagtagagattaaataatcctgtaaggtgtgaagtataatgtcccacacaacagagaatttttctgttagatgccatagggggccttttggtttaaaaagtgttaacgggttccaggaagcttaaggtgttgggtgaggtctgatagaattacgaggtacgtttgtgggtgagaaagatgaagttgctttagt

SEQ ID NO: 56559 - DNA, 280 bp, Homo sapiens
  misc_feature (11)..(11): n is a, c, g, or t
aaggatcccgntcactttctacacttccagacctgtgctcctacctttctttttatccagctcatcccaggctaagagtaaaccaggtagtagagattaaataatcctgtaaggtgtgaagtataatgtcccacacaacagagaatttttctgttagatgccatagggggccttttggtttaaaaagtgttaacgggttccaggaagcttaaggtgttgggtgaggtctgatagaattacgaggtacgtttgtgggtgagaaagatgaagttgctttagt

SEQ ID NO: 56560 - DNA, 486 bp, Homo sapiens
  misc_feature (79)..(79): n is a, c, g, or t
  misc_feature (164)..(164): n is a, c, g, or t
  misc_feature (265)..(265): n is a, c, g, or t
  misc_feature (396)..(396): n is a, c, g, or t
  misc_feature (415)..(415): n is a, c, g, or t
  misc_feature (486)..(486): n is a, c, g, or t
ttaaggggaactgacaaattggatgtagctagcgcactctgagggattacgggggatttctgtttgtgtttaaaatggnagataaaagcatatgcttaaccatatggctgtaatgagggagtgatcagtagaagagagatttgttgctggagactgccctaatnaataaatcagcaatatccttgagaaagtgagaggcaaagtacaaaacatacctgtctttccttctaggctgggagctgcttaaacaaagaccatgtttttnttaatcttaaatccctagttcttggcacatagtaggtactgactgaggttttggatgagcacatacacttcacacttaatccatttccagtaccttgttgggtgatgtaccatggggcatagagaagtcanaagacagtgccctgccttnaaaccatgaactcattagctgaggtaacctgaagcagatgagacaggagatgattgggtgtaagtgggagn

SEQ ID NO: 56561 - DNA, 332 bp, Homo sapiens
actgtttaaaaggctccaacactaaggtcctaactgatctggtccctgccttgtcctctcattctacctgtgacactctcctgggccccacccagtgctttaaccattccccgaggatgtcagcatctttcatacccccctcaaccctcaaaccttgccccctggctcagcacaaggaacagtcaggtctcctaggcagtaaatcactccctcctcttgctcccacaattgtaattatatgcttatctgcatcgcaaaactataagctcctctcagcatgggccatgttttgtcatctctgtatctccagcatctggcccgttatctggtac

SEQ ID NO: 56562 - DNA, 210 bp, Homo sapiens
ctgctcttaaagaactcaagttttctttagaactatttaaaaaacaccaaaggaaacctctgaaaatcctgtccatcgttcagtcagtagctgctgtatccagtgtctatcatcgtgaatgtcatggcatgtacagagaaactgaaatgctggatgcaattctaggtggtggtgtaaagtttttgagttggcagaaaataaagaataaaa

SEQ ID NO: 56563 - DNA, 300 bp, Homo sapiens
tctagagtgaccaaccatcctcttgtgcccagaactacaggactttccattttaaaactaggagagtcccacacaaaccaggactgttggtcagtcaccgtaccttcttgctgctagatatgtaattttctttggttttcatcaccggttcccatttctttgaaagtgtttgtaggtcacacactgtgtagtccatgatgaaaagaacaaaagatgtatgaattatggtgtgttgtggtggttcccaaagtagggtccccagaccaccagcagtggcatcatttgagaactccttagaaa

SEQ ID NO: 56564 - DNA, 476 bp, Homo sapiens
gattctaatcaggagaccagtgctcatgtgcacagctttgagtgtgaagatctaaaaattttagttggtaggatgattacagattattttcatcttcctctttacagattattttcatcttcctctttaaacttttgtatatttttcacattttctagaaggaagttttagaaacagaagtgggaaaaaaaacaacttaaaaaaagccccgggccaggcgcagcggctcacacctgtaatcccagcactttgggaggctgaggtgggcggatcacgaggtcaggaaatagagactatcctggccaacacagtgaaaccccgtctctactaaaatgcaaaaaattagccgggcatggtggcgggcgcctgtagtcccagctactcgggaggctgaggcaggggaatcacttgaacccaggaggcggaggctgcagtgagccgagatcacaccactgcactccagcctggcgacagag

SEQ ID NO: 56565 - DNA, 3309 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactctttta

SEQ ID NO: 56566 - DNA, 546 bp, Homo sapiens
  misc_feature (9)..(9): n is a, c, g, or t
tcagacganccatggttacgcccctgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacaggggcgtaacccatgggatccttgacaagaaccaca

SEQ ID NO: 56567 - DNA, 534 bp, Homo sapiens
taagggctttatattattttctatagtttgctttatttggtttaacttaaatgtaacttgtctcttaaaaattacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaagtaagagtcatgcactatgttccagatggtttcctcttgaatgttgcagaatgtgtgttttagaagctgagagtcactgacagctgagccatttataaagaggggggaaaagaagctgggagctaaaatattccactgccttccgaaaagaagtacttctccccacagctctgttctgaaagaaatagctcttcttaagaagtagccctttgtttcagtaagcagttgaatgtttggcagaaaataaaagttatttttgtaaaatcttttcactattctctaatagctgggctgtacattcagtattttt

SEQ ID NO: 56568 - DNA, 2688 bp, Homo sapiens
ttatgagaccactactttaatgactggggcgaggataataacgccgatcccccagacctctgggaggccgaccaactgttgttaggaatttgctccaccaaacatcttagggccagaataatgcctgttatggttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactctttta

SEQ ID NO: 56569 - DNA, 3403 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttaaatataattttttttccaagaaaaaaaaaaaaaagttggggcgcgaaagttaaaatttggggggccggaaaaaggagggcagacggcgggggtccaaaacggcggtaacagtggttgaaagagaacgccaggggaaa

SEQ ID NO: 56570 - DNA, 2469 bp, Homo sapiens
  misc_feature (9)..(9): n is a, c, g, or t
tcagacganccatggttacgcccctgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactctttta

SEQ ID NO: 56571 - DNA, 3422 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcaggcaaatataaattatcaaaattgactgaagaagaaaagcctgaatagaccaattaccatggaaggaattaaaagttatcaaagaactgtcccttcacaaggtggtttttacagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactctttta

SEQ ID NO: 56572 - DNA, 3221 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactctttta

SEQ ID NO: 56573 - DNA, 2679 bp, Homo sapiens
ctcattcatttgtttttgtttttgttgcatttgcttttgggttcttagtcatgaattctttacctaagccaatgtcttgaagagtttttttgatgctatcttctagaatttttatggtttcttagatttaagtctttgatccatcttgagttgatttttgtataaggtgagaaaggaggattcctggcatccatgaggaatagcatttattcctggatctaagttttgactaattaatgcttttaacattttaattaatgtgtttaacctcaaatggatttattgaaaccttaaaatatatgcaaaaattatatatgctaagatttttttcccctatttttatgttacgtcctctagatttgaatttacgttaagtgaattccaaagttaggaattgaaatcaaattcctttttttaggcttatgtttttatttccacaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactctttta

SEQ ID NO: 56574 - DNA, 3306 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaatacccgtacccctgtgttacactccgaaatactttgccttaaattgttgcgagagaggtagtctgacgccgggacctcaaagctccctgggtcgcacatgaacgtgggccatagggagaacgccgtatcactgggcccccggtgcacaaacttatttattaacacaaggggcacctatcgggcgcaccagttatgcatgtattctcgtcctgcccgcacgacgtaccacatcagtaagatgagaatt

SEQ ID NO: 56575 - DNA, 1808 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaagtaagagtcatgcactatgttccagatggtttcctcttgaatgttgcagaatgtgtgttttagaagctgagagtcactgacagctgagccatttataaagaggggggaaaagaagctgggagctaaaatattccactgccttccgaaaagaagtacttctccccacagctctgttctgaaagaaatagctcttcttaagaagtagccctttgtttcagtaagcagttgaatgtttggcagaaaataaaagttatttttgtaaaatcttttcactattctctaatagctgggctgtacattcagtattttt

SEQ ID NO: 56576 - DNA, 1425 bp, Homo sapiens
  misc_feature (1374)..(1374): n is a, c, g, or t
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgatatgagaaaagcaancctggacagaatatacggcttattgatagacgcatatcggatcctctagac

SEQ ID NO: 56577 - DNA, 2323 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaattccgaaattagagtgacttatatgggggtgagtatttgtgtggctgtatatgtaaaggtaataatgcagaaaatcggtttggagatcgggttagggtggacgtaagtaggtgggtccaggtaggtagggcggaagcaatgtcgggggggccagagggggggggtttgaattaaaaggggcggggtggctgtgtgccg

SEQ ID NO: 56578 - DNA, 1382 bp, Homo sapiens
agtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtaagggtataaattcaccaaaatctatttgaaactgttttaatagtctgtcagggcctgggccctggtggctcacacctataatcccagcactttcgagaggccaaggcaggtggatcacttgaggacaggagttcgacaccagccttgtcaacatggtaaaaccccgtctctactaaaagtacaaaaaattaggcatggtggtgggcacctgtaatctcagctactcaggaggctgaggcaggagaatcgcttgaacccaggagacggaggttgcagtgagccgagatcatgccgttgcattccagcccg

SEQ ID NO: 56579 - DNA, 1545 bp, Homo sapiens
gtgttaccccaggctggtctcgaacttctgggctcgagtgattcgcctgcctcaaccttccaaagtgctgggattacaggtgtgaaccaccatgcccggctagcattgtttttaataaccagaaagtaaaaataatccaaatgtccatcaaatgatgattggatacacaagatctggtatacctatttgatgaaatattattcagcaaaaaaaggaatgaagtagtgattcatgttacaatattaataagccttgaaaacatgctaaatgaaagaagccaatcacaaaagaccacatattgtatgattccatttatatgaaatgtctaaaataggcaaatccatagagacagaaagtaaattagcggttgccaggaattgggaatggggagaatgtgaagtgactgactgctaatgggtatggggtttctttctgggatgatgaaaatgttctggaagtagtggtgatagttgcacaactgtgaatatacaaaaatccattgtattatacacttttcaaatgggtgaattttatgataagtgagttatatctcaatttaaaaaaggaaaaatagtttttcagttgactaagttgtgttatctagaaatagcctcaaattataagtttactttttcctttctaatttttatgcttactattatttttcttgtaatagcattagctagtacagtaatccagaaaatgttaaataatttttcatgataatggtgatagtggacttctttgacttgttcctggtcattatagaaatagaaatgcttcttcactaagcatgatgctggcttttggggttggtgtggcatgagacacacacgttttatcacattaagaaaatacctatccctatttctttataatctatggagatttttctttgatctcatattgcgtgatatattaacagattttgtaatatttaactcattttacattcttgaaatgatcctacctggttgtggtgtatacttattttaatattctaacattttacaatttttgcatagttagaaaaattgacatttatttattcttatcataaatgaatagcatgtacagcattgtttgtaatggctcccaaattggaaataatctagatgttcatcaataatagtctgtttaaagaaagtgtggtagagacatagaattaaatacaacgcagacattttaaaaatgagaaatatctatatatattgctatatccaagaatatccaagattatgtgaaaaaagaagatatgcagatgaatattttaaatgagattccatttgtgttaaataatgcccatagtaacagtagaaattatgtatgtttactcctatcactgtgcatgcatagatgatttcccgaaagatattcaaacaattaacagtggttactttagggtaatgctggtttgggggaagcagtggtatgaagggagggagcattcctttttactgtatacctgtatgtaatgtttcaggttttttcttaataagccatcttacctttataataaaaagttaatttttaaaaagttaaagg

SEQ ID NO: 56580 - DNA, 419 bp, Homo sapiens
cattatttgcacaggtattgatttaattggcgttctgaatacaacttggatgagttcatggggtctaagggtctggccaccttggaagaactgggcacacatggcatgagcttcgtgttgggtaccttcagggatgtgttggcagactcagcaggtttcccttttcctggcttctcttgcataacaataacatacatttggaggatgaacaatgtataatagtgataagtgtaagctttttttctaaaatatttggtcattagtgtgaatgcagcatcttggtgggtgggtggagggattgttgttggttcagagcaaatgtccatgaatatgagagaattgaaaataatacaataaaggattttgtacatcccttatcagtggagaagcctggaagatttagctagccctgaatgtgc

SEQ ID NO: 56581 - DNA, 318 bp, Homo sapiens
cggcctcccaaacggaattgttaaacagtacaaatgatcagtgatttcagttctagacagtacttccttggttaagcccatgagtttacctcatgtagccaacagagaatgcaagttttcatctagggcagagcctttaagtcctttgacatccagagtcctctgagccaagcaagaggatcccaaatagccactgaggctcaaggtgagatagatagtgacatattcccttgagctttcggttctcctcagtctcaagagcatgctgatctagccaagggccctcaagcctttccttggtcctaggcctctcaacag

SEQ ID NO: 56582 - DNA, 262 bp, Homo sapiens
tggatgagcagatgttcccaataggaacgcctgtagactgttcagaagaaattgcccaaatgagccagatgagaaggctgagggcagggctgcttttggctctgaggactatagatttatcctctaggtgatgaggggctattaacggctggtgagtctggagaactgaacagtggaagctctattttaagattcacgtggcagtagaggatagaggtgtttggaagcggtgggcagttggcaagctatatgggagacattt

SEQ ID NO: 56583 - DNA, 281 bp, Homo sapiens
  misc_feature (249)..(249): n is a, c, g, or t
gtaataacaggaggttaaaaaaaaaaaaaaacagtcaccaggcttgaatacatacttgagcacacaactggtgttcttctttttctatattatttttcaactttgaaaaaaaattaatcaaaaaattgataaactattaatcataaaaaatacttattttagatcctgcaactaacagaaagtaaaattttaaaaggatatgaggtccagcaatatcacatgaggccagggattcaagaccagcctggncaacatggtgaaaccccatcttttacttaaaa

SEQ ID NO: 56584 - DNA, 525 bp, Homo sapiens
tggcacctgccttctttctccttttatgttatcataagtggcatgtatcaaaccaaacaggctaggggagaataggtctaattgtgacagacttaaaaacaacacattatttggaaagacaagccatgggaaagaaatatggcgtttctatttttttaagataatttagtatgtacaaaagtatccaaatttaaatatagttttcaatggctgatagttttgttttctcacccttcaatatttctagaaaacatccttgcatacaaagcaggatagctaagaaagggctgtaacaaacaaaacttcaagtgtctagcacatactacatctaagaggctaaactctgataggaaaagcactttaaacataattaaaagcttaatgtaaattagtagttgaaattctaggccggtgcggtggctcatgcctgtaatcccagcactgtaggcggccgaggtgggtgaatcacatgaggtcaggagttcaagaccagcctgaccaacatggtgaaaccccatttctact

SEQ ID NO: 56585 - DNA, 566 bp, Homo sapiens
ggacaacagccagcaagacagtaaggacttcagttgcacaaccacagggaaatgaattatgccgacaaccctaaggagtatgaagctgatctgttcctagcccagtgtctccatgaggatgcagtcagtgaacaacatgatttctgctttctgagaccctgaacaccggaccaactgacatacactggactcctggcctatgcaaaacgatctgagccccttttctcctgattaatccactgcaggcctagagccaagctgccctgtttattaaaacgggatacccactacagcgtccactgcagatgcacttcaagatttcaaagacttccagccacaagaagacggcaagtgaagaaaataggagaaagtgaatagatttcaaggcaaagtcttgagaacttcttaagaattgaaagagaccaatctgctgagcttatgaaaagaaagcaacaaaaaactgaatagccaattctaaaggccaaaacagttgagaagagtaaagaggaaagaaggaagaaaaagcaaacatttactttagtaattttaaatgtttgaagattaaa

SEQ ID NO: 56586 - DNA, 1873 bp, Homo sapiens
gtatgctcctgggaaccctagttccacaggataataggtttttcataaagaaacgtagggtgtgtatgtgaaagtggggtgaggttccctggttgagtaggtttggcagacactaaagcgagctacacgatcatctttgctacaggcctctcacaaccttcagcatgccagcatgggtcaggcctcttcacagggccaagaaactcatagcatctcccacattactctcatcacttctccaaggtgcttttgcaagactggaattccttggacaccattggagaagccccgctttttctggaacagcggcaaccaagaggccttgcagccctggaagtgggtcagggcccttggtggtcacctttttctccccagcagctctgcagaggtggcctgcttggcagtgggacatcaggggaccggtcctgctttgagatggcagggtccctgttctgagagctctccagcctgagggcattgagctgaggctccaccctgagctctcctgcagggtggagggcattgtttcccagcacccaggcagtgtcttgctggtgtgtcgtgagtgctggatgtccaagtccctgctggccacggagggctcctgcctctcttcttcagcgccacaaaattacatggaggccagctggtttgtgaggagatgtttattttttaattcttttgtttaccgaacgtttactgagcatctaccctgtgccagccctactcgtacgctctgtctccaaagatgaaaaaggacttctctgccctcaagggaaccccacagtatcttagaggagacaatcatgtcggtgagatggtgtggtgatgaagcctgctgggtatacagctcagggaaagtcatcgatgatggctcaggctcagcctgggcacgccccagaggagagagatggagtggggcctcaaagggcaggtttaggcagaaaagaaaaagggcattccagctggggcatgtgcaaaggcagcacgtaatgtgtaagttctagatcgtcagggaggaagggtcagttgggtgcctgtttttctgtttttagtcctttaaaatgagtagaagcaacctgttaccctggaaagagcactggacatagacctagtgctgcgtgatgttgagcacgtttcttcttccctttgagtcccagtttcccttttggttacagggggatagtagcccccagggatcatgtgaaagtgagaaagcccttttcacactgtggagcggtgcagatgtgggaaacctcaaagatggttgcccattttaaatcctttcatctctcatctctctttcttctctcccttctgccctgacgtagccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgca

SEQ ID NO: 56587 - DNA, 1563 bp, Homo sapiens
gcacttaggctagtacgaggctcgggtgttgatgctgtgttcctcaaaagggaattggcttgtgtagtttcctaccatatcatattttattaaattagaggggccctgacttttaaaacccactggctttctgaagtgttttccagtgaatgactcattcagccagtgcttgttgcatttatgttagctaccaggtgccaagtgtgcagacacaatacagagccttcaggctctcgacaggcaagagaacacctgtaaatagatggtcccgacattgagaggcagcatggtagagtgggcagaccttgtgctctggactcaggttcaaagttcagatgaagctcaatggcctcttagttggagcttagaaccagtatgcccaaagtgctgggtctgcaggaagtacccagtcgatggtaggctgcacagaattctgatctctaccttgagccatgctgagccacaagttggtctccttgggaggtgccatctctcatctgtccctcccccagccatgaaagcccattcccctatgctggctttcagaggctgtcgttaacttactgcccagagcctcgtagttttcttcccctgccctgatggttgggtgttttcctttaaattctctcagccttacactcacagaagccaactttccacaggactgaagacaaagtgtttcatttagctgttactgatagacacctttacaaaggttactaatgtcccagcctttttaaggagacacactcattcatcccctactatgtgctggcagctttacctttgtcatttcatcctcatggccaccctggaggtggcattgtgtaacctcatcttgcacattcgggaaacggatgcttaggagagggaagcagcttgccagttaaacagcccagaaggagcagatctggggtcagaaccggacctggtgggcttgcaagcctgtgccttttccactaactcctatagactcctggagctagaagcacttgtgattcttgttttaatttactgatggcttcaggggttaacagtaggcctagaattgtttgcctctgaaattcatggcccctgacgttatgtgctttgaggttttgtgcctgctttttgctgtggtcctgtttttttcataacaatatactggtatagcttccactcaggtaagtttgattgaacaatgatacacagctgcaccggggggtcaccttttcacaaatgtagacctccatgaactcattggatgaccctggacagagcggggctattcccattttgcagacaggacagcagaggctccagacaatgcctttcctttctttttcactggactcaagtgtccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcc

SEQ ID NO: 56588 - DNA, 497 bp, Homo sapiens
  misc_feature (365)..(365): n is a, c, g, or t
  misc_feature (390)..(390): n is a, c, g, or t
  misc_feature (422)..(422): n is a, c, g, or t
tgttcagcagaaattggagaccagcaaaaggcctccatctggaacttccactacctccaagagcacctctccaaccctcacgccctccccctcacccaaagggcacactgcagagtcctcagtgtcttcctcgtcatcccatcggaagtttcaatagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcaatgtgctattgaaacttctaanactaggcctagttttagaagtttcnatagcacgatcagaagatttggactattccantgataaaacagaagctggtattaaggagcttcagaagagtatggtgcgctggaaaaatactggcaggtagtatca

SEQ ID NO: 56589 - DNA, 1019 bp, Homo sapiens
tgttcagcagaaattggagaccagcaaaaggcctccatctggaacttccactacctccaagagcacctctccaaccctcacgccctccccctcacccaaagggcacactgcagagtcctcagtgtcttcctcgtcatcccatcggaagtttcaatagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgca

SEQ ID NO: 56590 - DNA, 3026 bp, Homo sapiens
tgttcagcagaaattggagaccagcaaaaggcctccatctggaacttccactacctccaagagcacctctccaaccctcacgccctccccctcacccaaagggcacactgcagagtcctcagtgtcttcctcgtcatcccatcggaagtttcaatagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagttcttctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatggggggtatgtattatggtgagaggttagccttcctggcacatcttcccttaaaacttctaacttgcccctcctagtccaagtcacctctcagatgaagtcttttttgaccccctttcagccactgggtcccttagtgctgtgtatgtgactgctgtagcattccactgcacctgctgcatacagcttacattggagatgtgtatgtcaaacgcatttttctttattgcaaagagagtctattatagaaggaaagaagtggaggcctgctgtgtggatcccttcttcttcctagctttcagtttccttatctgcaaagtggaaggtcagaccagatgatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattttgtctacatcctattaatgctgtgttcctcaaaagggaattggcttgtgtagtttcctaccatatcatattttattaaattagaggggccctgacttttaaaacccactggctttctgaagtgttttccagtgaatgactcattcagccagtgcttgttgcatttatgttagctaccaggtgccaagtgtgcagacacaatacagagccttcaggctctcgacaggcaagagaacacctgtaaatagatggtcccgacattgagaggcagcatggtagagtgggcagaccttgtgctctggactcaggttcaaagttcagatgaagctcaatggcctcttagttggagcttagaaccagtatgcccaaagtgctgggtctgcaggaagtacccagtcgatggtaggctgcacagaattctgatctctaccttgagccatgctgagccacaagttggtctccttgggaggtgccatctctcatctgtccctcccccagccatgaaagcccattcccctatgctggctttcagaggctgtcgttaacttactgcccagagcctcgtagttttcttcccctgccctgatggttgggtgttttcctttaaattctctcagccttacactcacagaagccaactttccacaggactgaagacaaagtgtttcatttagctgttactgatagacacctttacaaaggttactaatgtcccagcctttttaaggagacacactcattcatcccctactatgtgctggcagctttacctttgtcatttcatcctcatggccaccctggaggtggcattgtgtaacctcatcttgcacattcgggaaacggatgcttaggagagggaagcagcttgccagttaaacagcccagaaggagcagatctggggtcagaaccggacctggtgggcttgcaagcctgtgccttttccactaactcctatagactcctggagctagaagcacttgtgattcttgttttaatttactgatggcttcaggggttaacagtaggcctagaattgtttgcctctgaaattcatggcccctgacgttatgtgctttgaggttttgtgcctgctttttgctgtggtcctgtttttttcataacaatatactggtatagcttccactcaggtaagtttgattgaacaatgatacacagctgcaccggggggtcaccttttcacaaatgtagacctccatgaactcattggatgaccctggacagagcggggctattcccattttgcagacaggacagcagaggctccagacaatgcctttcctttctttttcactggactcaagtgtccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcc

SEQ ID NO: 56591 - DNA, 572 bp, Homo sapiens
aaagagttttttttaaaaaaaggaccctctcccccccccattaagggcccccccgggctttcaccttttaaggcttccgggtcagaatgtgtgtcgggaatttggaaccggataccaatttcaccccagggaccagctattgcggggatttcgaatttaatcggcccctctatagggaatttggcccttaaggcaaagaattcggcacgagggatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgca

SEQ ID NO: 56592 - DNA, 1073 bp, Homo sapiens
tgttcagcagaaattggagaccagcaaaaggcctccatctggaacttccactacctccaagagcacctctccaaccctcacgccctccccctcacccaaagggcacactgcagagtcctcagtgtcttcctcgtcatcccatcggaagtttcaatagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagttcttctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgca

SEQ ID NO: 56593 - DNA, 1545 bp, Homo sapiens
tgttcagcagaaattggagaccagcaaaaggcctccatctggaacttccactacctccaagagcacctctccaaccctcacgccctccccctcacccaaagggcacactgcagagtcctcagtgtcttcctcgtcatcccatcggaagtttcaatagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagttcttctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatgggggccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgca

SEQ ID NO: 56594 - DNA, 1050 bp, Homo sapiens
tgttcagcagaaattggagaccagcaaaaggcctccatctggaacttccactacctccaagagcacctctccaaccctcacgccctccccctcacccaaagggcacactgcagagtcctcagtgtcttcctcgtcatcccatcggaagtttcaatagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgca

SEQ ID NO: 56595 - DNA, 529 bp, Homo sapiens
tgttcagcagaaattggagaccagcaaaaggcctccatctggaacttccactacctccaagagcacctctccaaccctcacgccctccccctcacccaaagggcacactgcagagtcctcagtgtcttcctcgtcatcccatcggaagtttcaatagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacgcccgtagggcgtactgctgtccaccaaaaccttgcctcgcccagtgccaggctcaccacaccaacttctaacagca

SEQ ID NO: 56596 - DNA, 334 bp, Homo sapiens
atgcctctggcttgtttgactgcaaaaggtgatgtgcaggggtagaggtagggtactaatttacagtcaccaaaattagtactgatattaatcagtttagttggattaagatgaacaatgtttaatgctttaaggatcattttttgccccaacaggactgtgctatattaaatgacaccgtgcccaaaagctcaaaaattacatagaaagtaaagtacttcttgaatactaaaacagttaagcataaaaggttgtgaattggtccaaagtgatattaacttaaacatttaatcctacgttctatcttagctgtaccctctaaaaatgctaagaa

SEQ ID NO: 56597 - DNA, 506 bp, Homo sapiens
taaggctgaataatattctattgtgtatatataccacattttcttcatccatttatctgtttatgagcacttttgttgtttctatatcttagccaacctcttgacacaatgtagttattctttattagctataggccattaatacagggtttgaataatatgcttctatttgattgctggggctgtgggatttttgcctttgtagctaaatcagcagcaagttaaagtggtgtaggtctgtgaaggattgtaacctcctcttcccccaaacaagggcattgcttgtccaaatatgtgatcattataaatgtgtatatgtctaaatatgtaagtcaccataattgattgactgattgacttctaggaagaccctcacatttattgctagttccagaggcacttctcaaaatgattctcttttctttcaggtgacattcactgtgaactacactttctttccacgaatttgagcagaacagtgttgggaggcagttttcagtgtctgt

SEQ ID NO: 56598 - DNA, 216 bp, Homo sapiens
cctatgtccaatcagtctgttttctcctacttaatagcaccttctcagcttcccttttctttttagtcagtctggatcccattaccatcatttcagtcaccttccagtcccttttactctcacatgtttttgttgtcctgccacacctgctgacaaccccaagccagagtcattccaacctctctcctcccatgctctgacatgatagtagctgcc

SEQ ID NO: 56599 - DNA, 509 bp, Homo sapiens
ttaaaatattttccttctctctttattttttcttaagagatgggtcttcctatgttgcctaggctggcctcgaactcttgggctcaggcggtcctccctcctcagcctgcatcttcttaacacaaaaaccgagaccatgtcactcccaagcttgaaatatgcccctgacctctaggagcagtggaaacccctgacaccaacgccctccacaccaggcccctgcctctcctgccccgttgcctacccaccctgagttctaggcacagggactcacttatcctacacacaccagagcttgcaggcatgacatgccgcctgacgctgcctgggcctaggtagccctgcttctgacccggctgtgggttccttgggccccaggcaggctgcttcactcactcctctgtagctcctttccccagttgaacagtggccatagccctgtcacggacattaagtgattgactcgtgagcacttggaacactgacctggggtgttccgtgctagctct

SEQ ID NO: 56600 - DNA, 3560 bp, Homo sapiens
  misc_feature (1826)..(1826): n is a, c, g, or t
  misc_feature (2017)..(2017): n is a, c, g, or t
attcttatattttgttacatacaacagtatcatctgttttgtcaagtgcagtctacctttaatatctgattgaaaatatagcacaatacagtatcagaaactatactgggtaaggtcctaggataccttcatattgatttcaactctgcctctaactttgggactttggttgggcgcagtggctcatgcctgtaatcccagcactttagggggcctaattttttgtttattttttgtagggatgaagtctcactacctttcccaggctggtctcaaactcttggactcaagggatcttcccacgtgggccttctaaagtgctgggattacaggtgtgagccaccatgcctggcctacatttacataacttattacaatacattgttatagttctattttattagttgttgttaatctcttgctgggcccactttatagattaaactttataataagtatatatgtgtaggaaaaaaacatagtatatacagggtttggtatttctgaggtttcaggcatccattaggggtcctggaatgtatcctgcaaggataaggagggactatagtatgctatttaactttcttttagtaatatgagttgcaagtaaaaattcctggtatagtattattattacaacaagacagtctatgcctgttgaaactggcactttttctttcccaaaactaattttattctttaaggggcatgctatcttgaaaaggagggcaaatagagctgcctgtgaaaaggaataatataaaacggagacccggccgccgtgatgctgtcccggtcccactgtgtcccgggcgttcagccactcgctctctgccttccagaaggggaactgccctctagggagacattccctgcctggggtctccttatgccagggaccaggttaccctaacagcaggaaggttgtcattaacaacagtgtcttcagtgttcgcttcttcagaactacaactgtatgcaagtatgacttggttacagtcaaaaccccagcgtttgcagaacctgtcacagagggagatgtcaggtgggagaaagctgttggagacacagttgcagaagatgaagtggtttgtgagattgaaactgacaagacattggtgcaggttccatcaccagcaaatggcatgattgaagctcttttcgtacctgatgggggaaaagtcgaaggaggcactccgcttttcacactcaggaaaactggtgctgctcctgctaaggccaagccggctgaagctcctgctgctgcagccccaaaagcagaacctatagcagcggcagttcctccccatgcagcacccatacccactcgatgccaccagtgccctcgccctcacaacctccttctagcaaacctgtgtctgcagtaaaacccactgctgtcccaccactagctgagccaggagctggcaaaggtctgcattcagaacatcaggagaaaatgaacaggatgcggcagtgcattgctcagcgtctgaaggaggcccagaatacatgtgccaatgctgacaatttttaatgagattgatgtgagtaacatccagaagatgagggctcggcacaaagaggcttttttgaagaaacataacctcaaactaggcttcatgtcggcatctgtgaaggcctcagcctttgccttgcaggaacagcctgttgtaaacgcagtgattgatgatataaccaaagaggtggtatatagggattatattgacatcagtgttgcagtggccaccccacagggtctggtggttccagtcatcaggaatgtggaagctatgaattatgcagatattgaacagaccatcacngaactgggagagaaggcccgaaagaatgaatttgccattgaagatatggatggtggtaccttcaccattagcaatggaggtgtttttggctcactctttgaacacccattatcaacccccctgtctgccatcctggggatgcatggcatctttgacaagccagtggctataggaggcaaggtagaggtgcngcccatgatgtacgtggcactgacctatgatcaccggctgattgatggcagagaggctgtgactttcctccgcaaaatcaaggcagcggtagaggatcccagagtcctcctctttgatctttaggaggaacccacacaccctacaaattgatcatgcaggaactgaaaaccagtcttctccctgtcccctcatgggtcccaggttagcctggtgacaggcacatgctgttggcctcaagcaaggaagcagagcactatgtaaccagcagtcacagcttttttcttggtgttcctgcctggctctctccctctctgcacctgtctcataccctcgaatatcttaattccttaggcttgagagagagccttaatggatgctcattcatattcctgcctttcttccatcagctctctgcaaagatgattttgcttctccctagtgctggtatactatagagaaacccccgaggaccatgtgattaagttcctatcttttgaaagtttgttctgcagagacatctaggaggatgctgtgcctcccaagctcagagcagcctctgtcctggctgtgcacattctcgattccacttgtatggagggattgaacacaggcaaagaggtgctgctttccttcttcaatggcaccttcattctccattgtcattgacttcaagatgcctcttctacctctaccaggaagcacaggccaggggatctgggtgtgtgaatgggaggagagagcagaggttccctgaggtcacgtgttgtaatcatcatagaaggagagcccaggtctgccctcacgctctccatcataggctcacaccaagaagactcatcttggcacaatctcacacagctggggctgtagcaaccctttcctggttgctgggcctcattctagcaccttgttcttagagcagattctagcacatcatggcagtgaaccaagcgtagtcccgaagaagggccagagcctggtagagattagggaagggaggtctcctctagactcagattgccttgagcttttcaagtaagttgctgtaagcccgtgggctgaggaggcagttcttgttccttcctgcgttatagtggggccttgtctcttcctctgcaggacacagatttggaggacgtggactggggtaggaaaccaccctgagggtgttagtagatagtggtgtaatggatgaggtcatttctaagatgtgttgccggtggatctgggcacaatcattggaattccttggagctactgggattcatggctttgtatccaactgcatccaggcctgaggctgctgacatttgacactagggccagtagagagtgcctttttgtatcttgagccaagaagtgaggcctgggggtggggaggggggaaggggtgggagccaatactgagtgcctgcagcatctactactctgtcttcactattcagaacttgtaactaaagtatttaaagaaactgattttaaatgcaaattaaagggcagatgttctcaaaaaaataaataaataaaatggagatccatatg

SEQ ID NO: 56601 - DNA, 239 bp, Homo sapiens
gaatgggatcagggacctgcttaaaacagcagtctgacctctttttcatagagcagccatgctatgctcagggtctgcccctagttgctttgggcacttgaaacccaaagatggaattgcagctccttttgccctgaagcccagaaagcctgggtatctaaggctctcgggtctctgtttgcgcctgagaaactactctgccaagattccatgtagctctgtgtcagactgaagaccct

SEQ ID NO: 56602 - DNA, 2066 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggaggaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattggacctttgtgag

SEQ ID NO: 56603 - DNA, 2506 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattggacctttgtgag

SEQ ID NO: 56604 - DNA, 2336 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtaccaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattggacctttgtgag

SEQ ID NO: 56605 - DNA, 1907 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattggacctttgtgag

SEQ ID NO: 56606 - DNA, 2452 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattggacctttgtgag

SEQ ID NO: 56607 - DNA, 1724 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacaggtaccagtaaaagatttcttttttttcacttgatccattccaaatgaagtacaaatatatctacatgtttgtttcagaaatacttagtacttcttgcatagaaaagcagtcccttaaattattatttttctctgcattctttttttcctctttcttttcaggaagatgcataactgaatcatctcacaagaaatgtcacttagcatagtagacactctgcagatttaggctgagttaatgaatgaaattagaatcatctgagcattgactgagcccttccccccatccccaccccaatggagagtgtgttatggagggagaacagcaattacagacccctgagagagtacacagtggccgtcatgccacattctggggcctggattcactaatcttgtcgccctggctcagctcccaagtgcaaaaaatattcagaatcagcttgtaggttgtccctatttatcaaaggtgatctctgcctcttctgaccacctgagtttgcaggtgcacttggctagtctccagttgttgatgccacagcttttctgagtaaccattattaagctcagtcaccaggtacaatttaattttttgcaagtgattagcaactttgagtttcaagttcagctctagaatcttagagtcattataaaaggtactgcttttttgtgcctcagcttttttttttagctgataattattgtaatggaacactctgtgagttgtatttaaagtagagttgtatcttttgttaaacttgaaacacttgtgtgaaaagctgatggtaagtttaccttaaaaaaataattttaggctggtcacagtggctcatgcctgtaatcccagcactttggaaggcgtaaagccggtggattgcttgagcccaggagttcgagaccagcctgggcaacatggtgagacctagtctacaaaaattagcagggcatggtggcatgcacctatagttccagctactgacaaggctgaggtaggacgatcagttgagcccgggaggtagagactgtagtgaaccatgatcgtgccactggactccagcctggatgacagagtgacaccttgggca

SEQ ID NO: 56608 - DNA, 1667 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaataacagtacgtgttatatggatgccagcaccagacctactatcttattgttgcctggcctcacgggaacaagcaaggagtcatatatccttcatatgatccatcttagtgaagaattaggatacaggtaccagtaaaagatttcttttttttcacttgatccattccaaatgaagtacaaatatatctacatgtttgtttcagaaatacttagtacttcttgcatagaaaagcagtcccttaaattattatttttctctgcattctttttttcctctttcttttcaggaagatgcataactgaatcatctcacaagaaatgtcacttagcatagtagacactctgcagatttaggctgagttaatgaatgaaattagaatcatctgagcattgactgagcccttccccccatccccaccccaatggagagtgtgttatggagggagaacagcaattacagacccctgagagagtacacagtggccgtcatgccacattctggggcctggattcactaatcttgtcgccctggctcagctcccaagtgcaaaaaatattcagaatcagcttgtaggttgtccctatttatcaaaggtgatctctgcctcttctgaccacctgagtttgcaggtgcacttggctagtctccagttgttgatgccacagcttttctgagtaaccattattaagctcagtcaccaggtacaatttaattttttgcaagtgattagcaactttgagtttcaagttcagctctagaatcttagagtcattataaaaggtactgcttttttgtgcctcagcttttttttttagctgataattattgtaatggaacactctgtgagttgtatttaaagtagagttgtatcttttgttaaacttgaaacacttgtgtgaaaagctgatggtaagtttaccttaaaaaaataattttaggctggtcacagtggctcatgcctgtaatcccagcactttggaaggcgtaaagccggtggattgcttgagcccaggagttcgagaccagcctgggcaacatggtgagacctagtctacaaaaattagcagggcatggtggcatgcacctatagttccagctactgacaaggctgaggtaggacgatcagttgagcccgggaggtagagactgtagtgaaccatgatcgtgccactggactccagcctggatgacagagtgacaccttgggca

SEQ ID NO: 56609 - DNA, 435 bp, Homo sapiens
tgtgtttagaattaaaattaagacatgacttaaaacatgtaaatagtaatgtcttctgaattattcctttcagtgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacaggtaccagtaaaagatttcttttttttcacttgatccattccaaatgaagtacaaatatatctacatgtttgtttcagaaatacttagtacttcttgcatagaaaagcagtcccttaaattattatttttctctgcattctttttttcctctttcttttcaggaagatgcataactgaat

SEQ ID NO: 56610 - DNA, 639 bp, Homo sapiens
tcgctctagactgtaaccgcacaccatatgtaatcccagcttttctaatttacaaccatgattgcatttagacctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaatgcaatgattgcatttagaccctgaccagtatttaaaaccaaaaggatattctgaaaaatggccaccaatttttttagaagtagcatcccaagc

SEQ ID NO: 56611 - DNA, 1488 bp, Homo sapiens
tcaacatcgttgtgtctgtgtcatacagtatgatccatctatactgaagaattaggatacagatgtgtggtgtaaacaacagaggagtggcgggggagaatctcttgtacgccaaggacttattgttgtgctaacactgaagacttggagacagttattcaccatgtacacagcctgtacccttctgctcctttcctggcagcaggggtttcaatgggaggaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattggacctttgtgag

SEQ ID NO: 56612 - DNA, 1530 bp, Homo sapiens
aagaatgggcaaaacagctttcttttcagaatcaaaatgcagaacaaatggaaaaattatggtattaaccttcacaagtttgagcctccacaaataatgcaaccaagttttacatttttaacagcccttctactgattgcatttagacctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattggacctttgtgag

SEQ ID NO: 56613 - DNA, 1819 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatggtaatcttagaagctgaaacttacagccttgaccacaatttagaaaatgaaactctgaactttaatatcagtcgacttacatggtgattgttttagcatattttcattggattaaggaagtccagtattcctctacccgtttttatatttcactgccctttttaccaataaaaagttcccaacattttaac

SEQ ID NO: 56614 - DNA, 1707 bp, Homo sapiens
tcagtagaggcccggtgttaatcggccgagggggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacaggtaccagtaaaagatttcttttttttcacttgatccattccaaatgaagtacaaatatatctacatgtttgtttcagaaatacttagtacttcttgcatagaaaagcagtcccttaaattattatttttctctgcattctttttttcctctttcttttcaggaagatgcataactgaatcatctcacaagaaatgtcacttagcatagtagacactctgcagatttaggctgagttaatgaatgaaattagaatcatctgagcattgactgagcccttccccccatccccaccccaatggagagtgtgttatggagggagaacagcaattacagacccctgagagagtacacagtggccgtcatgccacattctggggcctggattcactaatcttgtcgccctggctcagctcccaagtgcaaaaaatattcagaatcagcttgtaggttgtccctatttatcaaaggtgatctctgcctcttctgaccacctgagtttgcaggtgcacttggctagtctccagttgttgatgccacagcttttctgagtaaccattattaagctcagtcaccaggtacaatttaattttttgcaagtgattagcaactttgagtttcaagttcagctctagaatcttagagtcattataaaaggtactgcttttttgtgcctcagcttttttttttagctgataattattgtaatggaacactctgtgagttgtatttaaagtagagttgtatcttttgttaaacttgaaacacttgtgtgaaaagctgatggtaagtttaccttaaaaaaataattttaggctggtcacagtggctcatgcctgtaatcccagcactttggaaggcgtaaagccggtggattgcttgagcccaggagttcgagaccagcctgggcaacatggtgagacctagtctacaaaaattagcagggcatggtggcatgcacctatagttccagctactgacaaggctgaggtaggacgatcatggttcactgcagtctcttacaggcgtgagttaatgctcccagcctggttccatttttttttttttt

SEQ ID NO: 56615 - DNA, 2384 bp, Homo sapiens
  misc_feature (873)..(873): n is a, c, g, or t
  misc_feature (949)..(949): n is a, c, g, or t
  misc_feature (970)..(970): n is a, c, g, or t
  misc_feature (1070)..(1070): n is a, c, g, or t
  misc_feature (1134)..(1134): n is a, c, g, or t
  misc_feature (1264)..(1264): n is a, c, g, or t
  misc_feature (1282)..(1282): n is a, c, g, or t
tgaccaggacttgccaacctgcaacttgccctgagagccaggtatgcgtgtgtgtatctggggagcacgccccaaacatgagcagggacggtgttcccagctatccgagaggtcatgcccaagccaaaaggaaggctctagctcttaaacatgaataagtttattcctttcatttccacagtgtcttatgcttgcttctgttttctccaaggaagtatggtgcccacctactcctccagcctgacgatccatgtgagggttccttgttcccagcccaattctcatgtcccacctttctccactaagaaacagccaaattttggcaagagtcgtggtaggaaaaaaaaacaataattgggcagatgaggatttttcgctttttgactagttctttctctagactttcctgtctttttaaaacttctagtttcccccttgagcgctccctcccagtgggtagaccatggaaggaatgaacaggggatggaagcaggggatgcagtccctattatttcaatagattggaaagatgggcccagaacaattgcgtacggtgttcagtgtaaattgaagatctggagttgcaggattgttgaggcaatttttagttgctttgctccatctaaacacaaggccataggatagtgtgactttgtagcttcatcaccgtatccacatcagaagtacaatgtccacttaatacatatatacacatgtgtatgtatacacatatacacatgtgtacatatgtatgtatacacatatgcacatgtgtacgtatgtatgtatacacatacatatatgtgtacacatatacatatgtatgtatacacatagatatatgtgtacacataaacatatgtatacgcatanacatatgtatgtatacacatacatatatgtgtacacatatacatatgtatgtatacacatacatatatgtgtacanatatacacatatacatatatntgtacacataaatatgtatgtatccatatatgtatatatatacacatgtatagatatacatctatatgtatacctctatatgcacatatacatatatgtntacatatatacatatatgcatacatctataatatatgtatgtgtatatatacacatacagtgtncacttaatatatatatctatcttgtgtgtatgtgtgtgtaaatatacacacacatacacacacgataaaatacagagtctaccacatgatgagcctctgctaggtccttagcaatcaaaccacatgtccngtcctggcccccattctncaactaaacacatgggccagtttaggggtccaggagggcaagaatggtgggtccacgtagaaaccaggtgagggaggagcagtccacagggctggggtgatgggctggtgaagcagtgttccaggaggggaactgccgctcacagggctgtcctggtcgccctcgggatacagccagacttgatccgagtggctcccggggctgaatggggaccgccgggtgcatatcccaggaggcagccttcagctcagtggggaaagcagtttccaaccttagagctgcccaacactagcacagggcacctgagaaaggaggggcccctctgcctttactctgtctcccactagaggcagctggttcctgcagggaactctggtggggggtgagggggtggctggttctcagtgggcaggggtgaccctactggggtcagtgggctggcaatgctggtcttcactaacaagagttgaaaatagccaggaagctaagccctggctcctgggctcctgggcagatgcttaattaggaggaagaaggaaccaaaatcatgaacgcaactggctctctcagggggaggctgtcaccctccaagctcttcttccccttcctcaaatggagattcacactcatccctagttcaggagagccgccattgatgatgaggaaatccgtgtcaaagaagctggaaagactgctattcattgtgagaattttgtttccactgctacattacattgtttcttcttgttttcccttccaatttccagttaagaatctttcacagaaaatttttaattttatcacaaactgcacagatatcacacagctgcacccccatttggtgacacaaagcatacccttctgtgaagattttcactttacgccaaggcatgattgtcactttacgccaaggcaataaatttttacaaattttgtataacaggagctgaattctgggttctcaaatgtgaaatgtggcaaaaaaaaaaaaaaaaaaaaaagatttaattcaagcattttgtcatgtggttcttatttcttcaaccaagtttgtttacagtcactgcctttgaaatacagtcaaatacatctgtttgcttct

SEQ ID NO: 56616 - DNA, 333 bp, Homo sapiens
tactactactaaattcgcggccgcgtcgacatcacaaactgcacagatatcacacagctgcacccccatttggtgacacaaagcatacccttctgtgaagattttcactttacgccaaggcatgattgtcactttacgccaaggcaataaatttttacaaattttgtataacaggagctgaattctgggttctcaaatgtgaaatgtggcaaaaaaaaaaaaaaaaaaaaaagatttaattcaagcattttgtcatgtggttcttatttcttcaaccaagtttgtttacagtcactgcctttgaaatacagtcaaatacatctgtttgcttct

SEQ ID NO: 56617 - DNA, 981 bp, Homo sapiens
ggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaa

SEQ ID NO: 56618 - DNA, 160 bp, Homo sapiens
tacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggc

SEQ ID NO: 56619 - DNA, 714 bp, Homo sapiens
taagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccc

SEQ ID NO: 56620 - DNA, 321 bp, Homo sapiens
aaaaaaaaaattccaaagaaacagagtaattttgctccttgcctcagccctaagtcatctcccagacaaaaaagcaatcatcattgtcaaatttaaaagggaaaaggaaagacttttatttgaatgaaaagatttttttcagtgtgatagagagggaagactgaaataaacagaatttacaaccttcgcacctttgcaccttcctcttctagcaatatggcaaactaaataacttgcactgaaaacgagttaaaaagctgtatacttttttaaaaaatatattttgtttatgtcattgatctgcacagtttgaatacaaaa

SEQ ID NO: 56621 - DNA, 1162 bp, Homo sapiens
gagagtttgtgaatattattggcatattctaccaaaaaaaaagtgaacaattttatgttccagaaaaatagcaaaggacaccaaacaagattgtgtgcctgctttgcctccaaggctccagctgtttgtgttctccatctcctctcgcctccaaaaaggccactgaccttcaagaaggccaaggtgactgacctggcctggttatcccaacaatctcgttatccatccatcttctttaaccctcacccctcataagccttgttagcctctattaaagtaagctgggattgagtccaaaggctggaattcagtcatagccaaaatatatctagttcctataggcaacatcttgagcagaaaataagcacacaccaatctctgcctttaaaaaaagcatgccaaaaaaaaaaaaaaaacagaaacagcatgcagatgttcattaagaacatggaacagtaatacattcccatgctagctactatatagaactattgtagtgaaaggacagcagctacattaagtagattaataattacagagattgatcatcttcgtctgctgtacagtttttgtttactggaattcatggactctacatcagcaaagcattgtcttgagctagttcctggggtgtggaagtagctttagttttctacaactgaataatgagctcttatttttctcttggaattctgtacatatatagcagtccttcataaaaatactattacctagaaaagcttatgtgacatcatcaaatttcccacagtgatcttttcttactggaagaaaatgtttatggtttgttctatgggggggaaatataccataagatatataattgaataattacaatgatttataataatgaaaaggattgtgtaattgtaaatgtctggtagcatagcatgcactgtgggttgtggaatagaagtgagagccacatcacagatgcttggccatgcagaccagacattgcattggcattgtctgcaggcagctccatgccttctcagatattcaagagccatttgtgattgtgcttcaaagtatgtaatacatagctctaggttcctcctccctccctccctctcttccttccttccttctttccttccttccttccttcctcctttcctttcttccacagtgcccttcttgc

SEQ ID NO: 56622 - DNA, 6023 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaaggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56623 - DNA, 591 bp, Homo sapiens
ctgatctccagaagataattaaaggaacttttatctatgcagtaactttcatatattaaaagtattttatgaaacttgtatgttaaatatggtaaataaaatcagtcttacaggttcttgcaaaacaagtataaatattaatagtttgcctttttgacctagaaatccagccaactaggtttcattttagcttgttattctaattagttcatgtcagagctaatggcctacatttatctgatggatctgtgattgaaataaagtcaaatgtggtgattatcacctttgatatttgacaggtttcccagtttgcacctttaactcacttatatgcctataaatttgctacacagacactcatctgtacatatgtcattttatttaaccttatagataagaattcgggatccaaaccagggaggtaaagacataacagaggagattatgtctggaggtggcagcagaaatcctactccacccataggaagacccacgtccacacctactcctcctcaggtaagacagagtgagctgtaatggatggcactatttgttcactaacctctactgaactcttctttcttctatagc

SEQ ID NO: 56624 - DNA, 493 bp, Homo sapiens
gcactctagcccgggtgacagagcaagaccccagttcattaatttaaaaaaaaaaaaaaagaaagaaaaggaactgtactgattttgagttactggatattgtaataaagttaaatttttaaaaagtagaatataaaccacattaataaccacttctgtaaacttttataaaacatcttgaactagaattgccatgccatattttttcaaaatattatattgttcttgccattttttgacagaccccttatccctctggacagaatgcaggtccaaccacgctggtataccctcaaacccctcagacaatgaattcacaacctcaaacccgttctccggtaagtaagcagaagcttgaaccaaattacattctctacctgtgtttgtgtgtgtagtggcttgggtttctttggcaaatatttttactggattttggaagtttgttccaaagatgatttattattatgactcaggtggtgggggtccgagctaa

SEQ ID NO: 56625 - DNA, 6269 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56626 - DNA, 6232 bp, Homo sapiens
ggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttttgacagcccagcagaacagtgccaatacattgcacagacaactggaagaggaggaaggttttggaacagactcccgtttacaggtccttggctggaagaggctggataaaatactgcatttttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56627 - DNA, 4626 bp, Homo sapiens
tgtgttcaaccccatgcacaaggtctctgcccatcatttcgaattcctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56628 - DNA, 4327 bp, Homo sapiens
cattctgccattaatctcgtgcttgctgaacatgaagaagaggcagtgtttgagttattttttaattggctactttccttgacttccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56629 - DNA, 5837 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttaatcttctttaacaggctctcttaaaatgttggcaaaaaagttggattttttttagggggaagcgggattatgggttgaaatggttaaaggaaatttccccaaggcgtggggaatcaagaagggcggaaatttgttgtcgcggaacacaagta

SEQ ID NO: 56630 - DNA, 6122 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56631 - DNA, 1747 bp, Homo sapiens
agggaggaaggagaggtggggtgggcggcgggcccgcaggcttgtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56632 - DNA, 1501 bp, Homo sapiens
gactagttctagatcgcgagcggacgctcgcgatctagagctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56633 - DNA, 3461 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgtgctttatctttttcaaactccttctgcaacggttcagtataccttccaggcgg

SEQ ID NO: 56634 - DNA, 2829 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctatttgcaaagtgcagagcaggcatggattgccaattctggaacagagcaaagccccaacttgccctccact

SEQ ID NO: 56635 - DNA, 1526 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccgtggactagtagccaaccgtggactagtagccaaccgtggactagtagccaaccgtggactagtagccaaccgtggactagtggccaaccgtggactagtagccaaccgtggactagt

SEQ ID NO: 56636 - DNA, 777 bp, Homo sapiens
ggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgccgtcgacgcggccgcgaatttagtagtagtaggcggccgc

SEQ ID NO: 56637 - DNA, 321 bp, Homo sapiens
ggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggagactcctccctgctgatagagcccacgtt

SEQ ID NO: 56638 - DNA, 238 bp, Homo sapiens
ctataagatacatgagaaactgccataatacagcttttgtaggtattttgtacttttccagtagtaaaaattgctaatttttaaattttaaaaaatgttcagtttatctggcagataaccttattttctgcttttatagtgcaattgggtatctcgaagagcagatcaagggcctaaaactatcgaacagattcacaaagaggctaaaatagaagaacaagaagagcaaaggaaggtc

SEQ ID NO: 56639 - DNA, 428 bp, Homo sapiens
acacctggtggaagaggcgtacctgtaagtgcaagttccctacaactcacttagttagacactggcacagactccatgaaatcctacctcatggcaagacagcagcttttattcgttgattctagtcaagaagaagaagaagaggcaaagactatcctttccatactcatattaaagcagataaagaatacacttgagttctttttacttggcagaagctagtctgcattaatttggtcttgattttttttttccctattttttcaattgaggtgacctgcaaataggtttaaaaatagtgccaaccatggccagggatggtggctcaggtctgtaatgctagcactttgtggggtcaaggcaggaggatcacttgaggtcaggagttcaaggtcagcctgacaacaaagagagaccctgtctctacc

SEQ ID NO: 56640 - DNA, 466 bp, Homo sapiens
attcccagcgtatcagaaaaccattgttttagcctaatggctctaagagtagcccaggagaagctgccatggatgagattggacttctgcgggttccaaagctggtgcttaccgtttcagctgatgtaacttttcagtaaaaatttttgttatcttttgtggcagggaatgctctggaacatgtattaagctttcttttgctttttcatgcagatcaaccaacccaaattgccaatgcgaactctggatcctcgaattttgcctcgaggaccagactttacaccagcctttgctgattttggaaggcagacacctggtggaagaggcgtacctgtaagtgcaagttccctacaactcacttagttagacactggcacagactccatgaaatcctacctcatggcaagacagcagcttttattcgttgattctagtcaagaagaagaagaagaggcaaagactatcc

SEQ ID NO: 56641 - DNA, 413 bp, Homo sapiens
catgtactcttcatctttgaagcaatggggagcaatcataatacagaaaggaacaaaaaagctttaattaggaaagtttatcatgttcctaaatcttgttcattgttattgtagattataaagttacttagtgcgaatctattctaaaacaaaaggtttctgtattctgtttttatctattaaatgtcttgtagctattaaaataatgtaatagcacataatattgtcaaccataatctcactattttaatagtaatttttattatttttactttttttggggggcctcactaatagcaaaaccagaaatttcagcaatgtcagctcatgacaaggctgcattatcagaagaggaactggagaggaagtcgaaatctatcattgatgaatttctacacattaatgattttaag

SEQ ID NO: 56642 - DNA, 478 bp, Homo sapiens
ccttctcttactccaaaacagactttatgtattggataccaagtaaatagtaggtttaagtaaaaaaagaaaagagacaatgtttttggcataccagaataagtctaatatattggtctctgttctgttacctgtaatttagggtaagacattgaaagaattggcccaaggcaatatgtagtctctgatccaagaattattcttaaaacttatttttttttccccagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaa

SEQ ID NO: 56643 - DNA, 855 bp, Homo sapiens
ggagcaggcgcctgtagtcccaacaacttgggaggctgagacaggagaatagcttgaacctgggagacggaggttgcagtgagcttagattgtgccactgcactccagcctgggcaatagagtgaggctctgtctcaaaaaaagaaaaaagaaagaaaattaaagataattctatgttaactccttaaatgtaattcctagttcttctatcacctttagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccagtaagtttatctcatgttacagttaatctaaccaatgagtgagatttatccaagccaggacttagagatgatttagggttcgaacaaaggacaataaaagaatcactaataacacaaactcatataactaactttaataaatttgaatttggccgggtgcagtggcttgcgcctataatcccagcactttgggaggccacggcaggcagatcacttgaggtcaagagttcaagaccagcctggccaacatggtgaaaccctatccctactaaaaatacagaaatggctgagcacggtggctcacacctgtaatcccagcactttgggaggccgaggcagatggatcatgaggtcaggagatcgagaccatcctggctaacacagtgaaaccctgtctctactaaaaatacaaaaaattagctgggtgtggtggcgggcacctgtaatcccagctacttgggaggctgaggcaggagaatcgcttgaacc

SEQ ID NO: 56644 - DNA, 6073 bp, Homo sapiens
ggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56645 - DNA, 6466 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagtttaaaagaaagtaaagtgacttctcctttggacagctgctgcatgtgtgcccattcctgggggtgctgtctggctatttattgtctaattcaaatcactcctgaggggagagagataaaacgagagagagtgagagagtgtgtgtatgtgcgtgtatgcgcacgtatgtgcatgcacatgtatgtatgtatatacaagag

SEQ ID NO: 56646 - DNA, 3973 bp, Homo sapiens
catgtgaataatgcattgtgctgccacatgaggatagttacagtgtcattaggcaataggaacctttcagcttcattatagccttatgggctataatgttgtatatgcagttgtatatgcagtttgttattgatcgaaacatcgttatgcaatgcatgactgtatataatgccctacaaacagtgtctgcctatattcctctttctagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56647 - DNA, 5589 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgaatgttcaggtactgagctcgaagttgtatcatgtaa

SEQ ID NO: 56648 - DNA, 2054 bp, Homo sapiens
tctagaggatcccggtattctacaagattatgattttaagtgtaatcatcatctgctttccacatataaaaatcaccttggttatctatagttcaatcttctaaagccttcaggcctctgaaattcttcaaaattcagaagaagtagaaggaagtttttgatgatgagtgaggtggaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttta

SEQ ID NO: 56649 - DNA, 5403 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattataggtaagtaacatttctgaaggcagctcataacatctgaaatccccattatgtcaactactaagtatacagtttgattttacattgttttcaaaacttctcctatgtagctcacttttctgtgcactgtcctttctgtctgtgatgcctggttgtctcaagcgtggagacaaatagctgctccgcctacagagaacccagatctaaccagctaccacatgccttgcatgctccttgggttgtttttcactacgttgcgtgtagctttttctttatcttttcacttctaacattcagggccgcc

SEQ ID NO: 56650 - DNA, 3162 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctgtaagtgcaagttccctacaactcacttagttagacactggcacagactccatgaaatcctacctcatggcaagacagcagcttttattcgttgattctagtcaagaagaagaagaagaggcaaagactatcctttccatactcatattaaagcagataaagaatacacttgagttctttttacttggcagaagctagtctgcattaatttggtcttgattttttttttccctattttttcaattgaggtgacctgcaaataggtttaaaaatagtgccaaccatggccagggatggtggctcaggtctgtaatgctagcactttgtggggtcaaggcaggaggatcacttgaggtcaggagttcaaggtcagcctgacaacaaagagagaccctgtctctacc

SEQ ID NO: 56651 - DNA, 2402 bp, Homo sapiens
agcggggtaacttagcgtgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagcttgtattaagagcccaaatgttccctttgaactctgctaatacacagaagagttggatatcatgatctttgccctgaggaatttatcttccaaagaaaggaagctcaaggagttgataccttctgaaatgtttttaataaaatctgggacatgagatggtggaaaatcccttaggataggccgtttgcatgtataatgttgattaaaagtttttgtacccattatgtcattta

SEQ ID NO: 56652 - DNA, 504 bp, Homo sapiens
ggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaatgcaggtccaaccacgctggtataccctcaaacccctcagacaatgaattcacaacctcaaacccgttctccggtaagtaagcagaagcttgaaccaaattacattctctacctgtgtttgtgtgtgtagtggcttgggtttctttggcaaatatttttactggattttggaagtttgttccaaagatgatttattattatgactcaggtggtgggggtccgagctaa

SEQ ID NO: 56653 - DNA, 261 bp, Homo sapiens
ctgagaaagaagtcaatggtataatacaaataatacatgaaataccaatttaccactcttaagaaattcatgtagtgtgtacatgaggtcatactgaagaatttattccaatcagactgaaataatgcactttatttatccagaagccatctgaaaatttcaactatctagacaaagccctctgggtgattttgatatgcactaaagtttgaaaattaagaatcatgaatctaaaacaaagtcagattagaatataagcaa

SEQ ID NO: 56654 - DNA, 352 bp, Homo sapiens
gaaaatccctgccctctcctggaaaactcataaaccaccccttgtttagcatataatcaagaaataactgtaagtatactcagttgagcagcccacagcactgctgcctatagagtagccattcttttattcctttactttgttaataaatttgcttccactttactgtgtggacacgccctgaattctttcttgcatgaggtccaagaaccttcctttggggtccggattgggacccctttcaggtaacagttacattatcatttatattaactcattatttaatacatcagtaaataaataatttttaaaccatgtgggacattgactgtaacttgcaaacattttagtt

SEQ ID NO: 56655 - DNA, 275 bp, Homo sapiens
gtgagggtttctgagttttctatgataatggcagctaagggcctcctgatttctttttctttcactgaggaagttgtggctgaggggatttcttttggcactggatttggcttgcaggcccactcgcagtttggtgtggcactagtgtctgatgagtggtgcccatggagcagccatggagctgaggcctgaagcacaggcacaaaaggaaggaatatggctctgggctctggggtgtaatggcactagtgtccagtgtgcaggcactctcactg

SEQ ID NO: 56656 - DNA, 276 bp, Homo sapiens
cgggggtgacagagtgagaccctatctcaaataaaaataaaaatagaatacaaggggggataaagatagacttaaaatacgctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaattttt

SEQ ID NO: 56657 - DNA, 378 bp, Homo sapiens
gcctctgcttccctggcaagctcagtctggataggacaagcttttggttttctcactacgctgcttgcaaagctgaaatcaaccaatggccgcatgtatgtggtcaggacctcctccagggcatccttagtgttaacatagatgagtctcttctgggtgggattgggttcctaagtacacacctggccccaagctcagtagggacaacccaattgtcagttctctctcatattatctacttaattgcaatctcaaaaaggaaaggacgagtgaatcctgcccaccagatgctccaggcatgcgatcgcatcccaagtatactcgttgtctttgctgctttttcttcttctccattagtaaccgaccagtgttttcctg

SEQ ID NO: 56658 - DNA, 324 bp, Homo sapiens
aaggctgatcaggcgtctgccccacccagggcgggtaaggtctgcaagcccccttacccaggggacctggggctgctggagtctcccatccagccacctccctcgactctagtgtggccaggaagctacagcctgccaggttttgggtggacctggttggtgtgggatgaccccctaagcccaaacaggtgtggtatgtggggtgcgtggtggtgggtcacactgcccacagccatcttcacagactccaagggtggcagcaccaggctgtgtccagggaggccagccacaggccagacaggcagcctctggacatgcagacag

SEQ ID NO: 56659 - DNA, 291 bp, Homo sapiens
catttattagcttctagttttaattgtttcccgacttctttccagatatttatctaggaagaaatgtcagttctcactgtgccgcgcagacacaaggggcgggtgcagactgcagaattttaagggctcttctgggcagcaggcaggagggctgtgtcagctcagtctagcaggtgttggctgagcacctactatgtgtcagatggtgttgggtggtgaagggtgacaggaatgactgggacgaggctcccactctgtaggggcctgttatccttgggggtggggtgctag

SEQ ID NO: 56660 - DNA, 186 bp, Homo sapiens
  misc_feature (2)..(3): n is a, c, g, or t
  misc_feature (137)..(137): n is a, c, g, or t
tnnctgaaacaaaagatacaccagaatgtaaaacccaggagggcagagactgttttcccagaacctagaacaactcctggcacataccagatgtaaaatcattgtagaaagaaagaaagaaagaatgaaagaaaggnaggaaggaaggaaggcatgaaacggtgcactattattgtatgccacctt

SEQ ID NO: 56661 - DNA, 375 bp, Homo sapiens
gttagcgcactcaacaggattagaacaatcagtaatggcttacaatataatttttttctaaccaaagggtttaatgcattcattttagttagaatgaaaataattgaggccgggtgcagtggctcacgcctgtaatcccagcactttgcgaggccgaggtgggcggatcacgaggtcaggagatcgagaccatcccgtcagaaatgctatagcagtggaggcacggtggctcacgcctgcaatcccagcactttgggaggccgagatcgcgccactgcgctccaggctgggtgacaaagcgcgactctgtctcaaaaattaaaaaaattacatttttacaaagttaaaaggaatactcagcagccagtggccagt

SEQ ID NO: 56662 - DNA, 252 bp, Homo sapiens
acttttggattagccaaagttttaaggtaaaataaagctaagaggaaaagaaaagatctagggacaaagacaagtagcaagaagtatttaaaaggaaattcaacaaatataaggggacatcaaaaaatttgtgggaaaatggaattaaaaggtaaaaataaaaactataaactttgtttctcaacataaactttatcaagttcaacatattttgtaatcaatgataccagccatttagtccattcctaaagg

SEQ ID NO: 56663 - DNA, 475 bp, Homo sapiens
ttgattttaatgacagggtaattcaagttgtttgataaatttattactatattgtaagagagatctttgaccatttttcttcctttttcttggacatcactttcttccctccccttctctcttttatgtttttatccttgttaaattttatgtttacgttaccatctttcttatactttcccctgatttttctcttttaattcctctttcattctctgcctcttctctttcagctctttctctaattgtgcctattccttgttcataagaagtggagctgttagtggtagaaccactgctcatggttctaccactacaaagtggaaagtagaaatactttgcactttggccactgttgcgtttttgccaaggtaaagttcccctgccattttgaaatagctgaacaagttaaagtaatatgttccaaaaactggaagtgccataaaaaactaaaaataaaaaaaaattgtgacta

SEQ ID NO: 56664 - DNA, 265 bp, Homo sapiens
ttttaaatgagcaaaattaagtttccaaagcaatatgttgcttgtggaaccacagagaaactgttatttatagtgctgatagtcttacaaattagttcaatattttttagaaaagcataaaaattgttcctgaaattatatttagggaatgttatggaaggagaatgatcactctacaaagatactctttgtaacattatgtataatagtgacagattaaaaattaaatgtttaatagtatgctttgatggattatattttatga

SEQ ID NO: 56665 - DNA, 660 bp, Homo sapiens
taggaaaggtattacttttgtttttaaatgcctttcctacactgtgattcttatattgccatctgtcacttgctacataagtaactatttttttccacttaggcatttaatgcatattcatgtttctctgtcctgcttttgagacacttgtcagattagtcccttaggtgtctttatgcagaacactgtttcaagtcgattcggcaatcatatcatcatcctcaaaatcagtacacccatgaacatatttggtttgtacaaggtattttataataagctcagataaaatgtttaaatatatggtggttcatgtagtcatagacaatattaatgagatagagaaaagagattgggtaaattatactttttaaaacagttttaccaattcagatgcagttcacttgggctgtgtggagtttgacttatgtttatggaaagaatgagaaagaaaagatcaaaacctggtataaaaaagagtagtggagaacaagataaaatgaaagtgatagcaaggcttgtaaggtccttatctacagtctggcagtctctttacaggggcctttcaaagcatagttggcttcataaaaattacgtgactacatttagcactatgtgaataagaagagggcaggcttggaggcacttcagatagaatgtgaa

SEQ ID NO: 56666 - DNA, 339 bp, Homo sapiens
gaaaccacaacacaaccagtaccaaatataccaaaaggaactattattttcacctcagtttacaggaagaagaaaatagagaatggattttgttttacctctaatatacacgtttgcttagggtaaagaagtagctttttgcttcccaccatggttaccttctgaggaaggtgataatttccttcttagactggttgttgacactacaataacttctaggtaggagggaagttataaaaataatatgaaattaaataaagaacaataaattaaaagacaagggagggaaatgggaaagcactgaaaaagccatagtgaatgaaaatgacttccaataaa

SEQ ID NO: 56667 - DNA, 500 bp, Homo sapiens
aagtgctgacccaagacagaggccttctaggctgctgaggagaccagtgatgaggacggccccagggtaccggccacctgcttggggaagccaggcaaggttccaaatcgggcctccagcgctgtctcacaaggcacccggccaagggcagaggctgtggggagcccagggcaggcaggggcccctggactgatgaaagccaagggtgtcctgactggaagtttatcacacaccaggtgccgcgctgggcatgactgcatcatctcacagcagtctctgctttaacagacgaggaaacagaggcccaaaagactgacttgcccaggatcacaggggaggcagggtcctcccagaccacccaccacctgcgctgctgagccacacacagttgctacatgacattctctgtgaggcttttttttggggacaggatctcactatgttgtccagactggtcttgaactcctgggcttgagcgatcctcctgcctcagcctccca

SEQ ID NO: 56668 - DNA, 223 bp, Homo sapiens
aaccttgtttgagtgaattagccttgtactctataatgaaacgaggaatcattgagagatacttaggcaacggattttaaatgagtgaataaggaagggaaaaacttcaggaaaatgcagaaaaaagcagcggagattttggaaaaaaaattctaaagcactttctaacgcaaacacattcgattttttatagctaaacaggataacagatcagtctattaag

SEQ ID NO: 56669 - DNA, 826 bp, Homo sapiens
gcaggctggtacaggccagaggtgttaggatccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccaggtggctgtgacgtggctcccagggattatacgttatgggtggctgggggctctgggcgggcctggagccagaagggcgacttattttttctctccttatgccaccccagggtggggagggagggaggtttcagactccagtttctccctttgcccttttattcccaagcctccttggccccagtataagtgtggggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctc

SEQ ID NO: 56670 - DNA, 1178 bp, Homo sapiens
gcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggagcagaagaagatctttacaatccaaggctgctacccggtgatccggtgtctcttgcgccggaggggctgggtggagaagaagatggtccatcgctccaggccccaccctgctgccaccccagaaggatctggatagctcagcgatgggtgacagtgacaccactgaggatgaggatgaagatgaggacgaggagttccagccagtcacaagctgttcggacttcgatgatctcactcgaacactcgatgacctacgctggaacacatgcctctgacatggtgggtctatgctctcaatctccggacttcggcccgtggatttgcataaggttgattgccaactcccttcctccccacgactgctatggcgctggcggggctgagcgatgacaacagcagccttcacttaggacgacacagcgggccaggaaacaggacgcacaacaccagagtcgagggtccccgaataagacgcgagcacgcccgggaggcgtgcgaagaacgcacctacacaaccggcaccaaagggaaacgacaacgacccgcagagaccgagaacagaccccgaaggctgtccactcacccaacgagtagaaaaagtgcccagagggcaaaccagagcgcgcgcacacacgcgcagaagcacccggcacacaagggacccaaccagagggcgccaagcgcgacgaaaacagaagagcagacccagaacgccacactaagcgagaagcacagtcacagagagcccggcacacacacaccgagtcaga

SEQ ID NO: 56671 - DNA, 1455 bp, Homo sapiens
gcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccaggtggctgtgacgtggctcccagggattatacgttatgggtggctgggggctctgggcgggcctggagccagaagggcgacttattttttctctccttatgccaccccagggtggggagggagggaggtttcagactccagtttctccctttgcccttttattcccaagcctccttggccccagtataagtgtggggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctc

SEQ ID NO: 56672 - DNA, 1360 bp, Homo sapiens
gcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacagggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccaggtggctgtgacgtggctcccagggattatacgttatgggtggctgggggctctgggcgggcctggagccagaagggcgacttattttttctctccttatgccaccccagggtggggagggagggaggtttcagactccagtttctccctttgcccttttattcccaagcctccttggccccagtataagtgtggggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctc

SEQ ID NO: 56673 - DNA, 998 bp, Homo sapiens
gcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacagggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaattttaaaccatctggctggatctcgtggcattcccccatcaaaccaaaaaaaacaaaaaaaaaaacaaaaaaaaaaaaaaaaaaaaaagggagagaaaaaacaaaaacaacaaccaccgcaaaaaaaaaaaccaaacaaaaaagaagggggccaggggggtattaataagaggatggcacggtaaaaaaaagagtgcagtggagacacaggcaacagaccaacaaagaacaagaaacaaaaaacagagcggcggaagataagggcagacaaaacaaaacccaaaaataataccagaaagacgagcagcataataccaacggacgcgacatctccgggactacacccagccccctcccaccgcggccccccggaaacacgcgatcgtaccaccaaccctccccgggcaccggcccctaagacccaacccacaccacacccacacgaacaccgacaaaaccaaccccaaacccgcccgcaacacaaaagaaaccccctgccgagaacccctgcgcc

SEQ ID NO: 56674 - DNA, 1417 bp, Homo sapiens
cacttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccaggtggctgtgacgtggctcccagggattatacgttatgggtggctgggggctctgggcgggcctggagccagaagggcgacttattttttctctccttatgccaccccagggtggggagggagggaggtttcagactccagtttctccctttgcccttttattcccaagcctccttggccccagtataagtgtggggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctc

SEQ ID NO: 56675 - DNA, 867 bp, Homo sapiens
gctcatctttgggctagtttcaggcatgggccattggttcacaacctttggtctctaaaatgtgcagggctgtcctaggcagcatgggggaccgttgagggcagaaaacatttcaagggcctggcttggttggaggttcatccagagcttgacacaaaagtaccagaacctgggtccttttccacttggccctctgagtccccaggccccttgcatgagagcccccatgcctaaagaaagcaacctcagttcaccaggcaggacgctggcagggctttctagcagcctccatgccagggcacaagggagctgtggagaagctctcatggctcttaatttttctgccttatctagtgctaggcttagggccggtgcccataggtcacttctgaaagctggctgaattagagcatgaccacaaggtgtcctgggacccaactctgcccctcacagatatgagcacagtggcagctctcaggttcatgcacctccttagagcagtgccaccaggatgcaataataaccaccatgcactgcctcttggttctcttgacagttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttt

SEQ ID NO: 56676 - DNA, 551 bp, Homo sapiens
agagaacagctacaagcttgggtggagtcaccataaacacacccaagctgcgtcctctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaactg

SEQ ID NO: 56677 - DNA, 756 bp, Homo sapiens
acctccttgaaggcttgagggaggttctggtggagcttggctgaatttggatggggtcaaggaagcgaacgtgtagtgccacctcaaactgcatccagagagagcctgcatttttttggctggcttggaaccccccgcccgccaatggattgtgggaattgtagttcagggaccatcggcccgggactgccaacttttagagcatcttcagtgagtgtttacctcatgtcaccagaccttaatctgcagaggctgcaggagccgggtgtgaggctcaggccttgtggacatccgctgccctaccctagcatagacgctcccaaattacaggccccacaccccgctgagggggtttgagggtgagtaattcagcctttgaagctcataaacaaaaggaagccacacaactaggagagtgtccccatccggtgagactttgcagacgacagcgtctcatgccgttgcccaggctggagtgcagtggtgcaatctcgctcactgcaacctccgcctcccgggttcaagcgattctcctgcctcagcctcccaagtagctgggattacaggcgcccgccaccatgcccagctaatttttgtatttttagtagagacaaggtttcactatgttggccaggatggtctcaatctcttgacctcgtgatccacccacctcagcctcccaaagtgttgggattacaggcatgagtcactgtgctggcctatttatttttaatgtattttactttttttaagatg

SEQ ID NO: 56678 - DNA, 1701 bp, Homo sapiens
acctccttgaaggcttgagggaggttctggtggagcttggctgaatttggatggggtcaaggaagcgaacgtgtagtgccacctcaaactgcatccagagagagcctgcatttttttggctggcttggaaccccccgcccgccaatggattgtgggaattgtagttcagggaccatcggcccgggactgccaacttttagagcatcttcagtgagtgtttacctcatgtcaccagaccttaatctgcagaggctgcaggagccgggtgtgaggctcaggccttgtggacatccgctgccctaccctagcatagacgctcccaaattacaggccccacaccccgctgagggggtttgagggtgagtaattcagcctttgaagctcataaacaaaaggaagccacacaactaggagagtgtccccatccggtgagactttgcagacgtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaactg

SEQ ID NO: 56679 - DNA, 1195 bp, Homo sapiens
ctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcaggacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaactg

SEQ ID NO: 56680 - DNA, 1206 bp, Homo sapiens
ctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtggtgataaactgccaaatgcctggaccctaaagctttgcaggacactgttgtcaaagactggtcctgatgctggaaagaactggcttcgctgcaggaaatcagggattatcccttaaccgaagtgtctggaatagttttcaagggtaggaatgaaatgcctcc

SEQ ID NO: 56681 - DNA, 1481 bp, Homo sapiens
ctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaactg

SEQ ID NO: 56682 - DNA, 1421 bp, Homo sapiens
ggaagattgccacacagctgctaaatggctgagccaggattccaacccagccagtctggctccatagtctgcacttgtatgctctgctgcctcaggtcatctgcagaatgaatggctggtgtgtttgtcttttacctccccccggacgtttctcctccccaccagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaactg

SEQ ID NO: 56683 - DNA, 1010 bp, Homo sapiens
ctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcaggtaggataagacactgcaccatccagggaggtgagaagggaacctgagaggggagctaggttctagggtttgactataggggatgtctacccctaagcatggggaagggggcagagtgaggactgtgccattgattaaagtgggtccaggagcggtggggtgcggtggctcacacctgtaatcccagcaatttgggaggctgaggcaggtggatcacctgaggtcataagttcgagaccagcctggccaacaaggcaaaaccccgtctttaataaaaacacaaaagttagctgggcgtggtggtgcacgcctgtgatcccagctacttgggaggctgaggcaagagaattgcttgaatccaggaggtggaggttgccatgagccaagatcgcaccattgcactccagccagggcgacagagcaagactccatcttaaa

SEQ ID NO: 56684 - DNA, 448 bp, Homo sapiens
attttcgggggccacccgaagggggttaacccattttgacccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56685 - DNA, 2522 bp, Homo sapiens
aaattccggcgacagcaggggcaaaacaggagctgattcgagctggcagagctgggccatggaaccggtagagacctggacccccggaaaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56686 - DNA, 1353 bp, Homo sapiens
aagggtgatggggtagcagtgggaggtgtggcaagtggctggggcgcccagaatccagcctctctgggctgtgggtgggcacgcccaggctgagtgatgctcctccactacctggcagtgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaaggtaggtgtctcgcagggttgagtgggaggaaccctcacctgagcctgtgcctttcctgggatgggggctaggaactcaaatgccctaggccactccctggcctcccaaaaacccactgctgctcctcaccccagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56687 - DNA, 2504 bp, Homo sapiens
aaattccggcgacagcaggggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgacctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56688 - DNA, 391 bp, Homo sapiens
tgtgccactccccaggcccccaggccctctgagtacagctcccggttctgctccttccactggcggaacttctctcctgtcagctcagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56689 - DNA, 414 bp, Homo sapiens
cagaacagcctgggtgtcagagttgtcattagggttagactagagggaaaagagctttgcaggcatgaagaaccatcccaaaaggtcctgacacctctgcttccccgagctgagccttactctccctccaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctggtgagtgaatgctggtcacactggctgcagcttccaccaacctggggggtgtgatggggggctggctgctgccagggaggtgacttgccctctttctggcacagagctccaggctacagacagag

SEQ ID NO: 56690 - DNA, 466 bp, Homo sapiens
ggtaggggcgatcgggctcaggctacatagcccgctcccctcccccagtgcagccacgtggctgggatctgccacaacatcctggtctgctgccccaaggagctgctggaacagaaggccgtgctcgagcaggtgcagctggacagtccattggtgagccctgccctcccacctctcacttctgaccccttggcagccttgtctgggccctgaaatagggtccaggatcccacagaaccctgtgctgccatggctggaaagccttttttgtacagatgctaaaatggaggcccagaggattggccagggtctcccgttgctctgcacctccccagtcctgaggggccacgcgggtgtggcctcaggtagtgtgttccagccttgggatggagacggggcaggggcttgggggcagttaggagaaagggagaggatgtgacctttcttggtttaatctttgaccagt

SEQ ID NO: 56691 - DNA, 2541 bp, Homo sapiens
aaattccggcgacagcaggggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56692 - DNA, 2562 bp, Homo sapiens
aaattccggcgacagcaggggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgcgtgaggagagggacatggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56693 - DNA, 1122 bp, Homo sapiens
acctgggtcgttataaggtcgtgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaagt

SEQ ID NO: 56694 - DNA, 943 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56695 - DNA, 982 bp, Homo sapiens
  misc_feature (8)..(8): n is a, c, g, or t
  misc_feature (953)..(953): n is a, c, g, or t
  misc_feature (956)..(956): n is a, c, g, or t
  misc_feature (960)..(960): n is a, c, g, or t
  misc_feature (963)..(963): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaaaaaaaacacnacncaanaanaacccaccgaaaaaaaacc

SEQ ID NO: 56696 - DNA, 974 bp, Homo sapiens
  misc_feature (8)..(8): n is a, c, g, or t
  misc_feature (899)..(899): n is a, c, g, or t
  misc_feature (906)..(907): n is a, c, g, or t
  misc_feature (915)..(915): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtcgttggngttctcnnactggggntgtgggcaaaaaaaggggggggaaaccccgggcccccaccttttaaggcccagtaaagg

SEQ ID NO: 56697 - DNA, 1211 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtcggtgcgagggtgggcgctgcttgagaggaggtatgggtggaagagggccaagaacgccacagatccgagttcaggccgatcacagctgggtccctttctcgcctactttctaaatactgctacccacccccaccccaccccgtgctcattttagtagagagaagtggcgggtttcgggtgggggtgaggggagtgaatggcgtttccagagactccgagaaaagaaaggttctagtgtcccgggtgctggtccgtccaccaagcactccgtcccctcggtcccttgtctgtttgcaggtttgtaggtctgttggcctgtaggtttcggcacaagtttcagcgagagaaggagaaaactgccttggttggaaccttgcaggtcagtgtgaaggtgggattagcccaggaccatgggtgggggtggcggaggaggggggctgggatatgagagggccaggtccgagtcgccctctcctggccccttctttctccacacccactcccatttcagtgcagggaaaggggtgtggcggcctttgctggggaaatggcggacgacaagtggggcggaggaggcctgcgtccggaaagtcagtagagtatgagaaatattttaaactcaagtgtctaaaattcacaaaaacagaaattgggacctgtgtcctcagttcatccactacactttcatttctccattgccgcctacctgtctttgcatttgtccttctgccagactctatcctctatcaccgtggagggaccactgacaacagaagacaagggaaaacgaaggaatttatctgactttggtagaggttaatgagagaaactgcccttaatctttgggggtggaggtctggtgtaggagactacctgagaggtactcacactgtcaccctcctagctatcatagcagagacccatctcctgcccttccctgtggacccaggaagagaaatgggggctcctgaggtcgatagaggaagacagaaaagaaaagaacaaagaaattgtatcctgttaatctgcctttatcaccaactcgaaatccaccctgtctgtgaggcacaaagccaaacatag

SEQ ID NO: 56698 - DNA, 1942 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagtgcagggaaaggggtgtggcggcctttgctggggaaatggcggacgacaagtggggcggaggaggcctgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56699 - DNA, 2374 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtcggtgcgagggtgggcgctgcttgagaggaggtatgggtggaagagggccaagaacgccacagatccgagttcaggccgatcacagctgggtccctttctcgcctactttctaaatactgctacccacccccaccccaccccgtgctcattttagtagagagaagtggcgggtttcgggtgggggtgaggggagtgaatggcgtttccagagactccgagaaaagaaaggttctagtgtcccgggtgctggtccgtccaccaagcactccgtcccctcggtcccttgtctgtttgcaggtttgtaggtctgttggcctgtaggtttcggcacaagtttcagcgagagaaggagaaaactgccttggttggaaccttgcaggtcagtgtgaaggtgggattagcccaggaccatgggtgggggtggcggaggaggggggctgggatatgagagggccaggtccgagtcgccctctcctggccccttctttctccacacccactcccatttcagtgcagggaaaggggtgtggcggcctttgctggggaaatggcggacgacaagtggggcggaggaggcctgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56700 - DNA, 1862 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggtcttattactgtggtgatagatgcacaacgcgcgagaagcgcgacaaggcagctacagaaacaaacacactggcctgaacgggggccagtgcctgaagaaccccggggagcaggcacgaaacacaaaaacagcgcacaaaacacacatacacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56701 - DNA, 1031 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagtgcagggaaaggggtgtggcggcctttgctggggaaatggcggacgacaagtggggcggaggaggcctgcgtccggaaagtcagtagaattcatcacaagagagctacaagagcctggaagaagctgaagactgctaccctccatccttactcaccctggacctgagagacctcttcaatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56702 - DNA, 889 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagtggaagaagctgaagactgctaccctccatccttactcaccctggacctgagagacctcttcaatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56703 - DNA, 1170 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtcggtgcgagggtgggcgctgcttgagaggaggtatgggtggaagagggccaagaacgccacagatccgagttcaggccgatcacagctgggtccctttctcgcctactttctaaatactgctacccacccccaccccaccccgtgctcattttagtagagagaagtggcgggtttcgggtgggggtgaggggagtgaatggcgtttccagagactccgagaaaagaaaggttctagtgtcccgggtgctggtccgtccaccaagcactccgtcccctcggtcccttgtctgtttgcaggtttgtaggtctgttggcctgtaggtttcggcacaagtttcagcgagagaaggagaaaactgccttggttggaaccttgcaggtcagtgtgaaggtgggattagcccaggaccatgggtgggggtggcggaggaggggggctgggatatgagagggccaggtccgagtcgccctctcctggccccttctttctccacacccactcccatttcagtgcagggaaaggggtgtggcggcctttgctggggaaatggcggacgacaagtggggcggaggaggcctgcgtccggaaagtcagtagaattcatcacaagagagctacaagagcctggaagaagctgaagactgctaccctccatccttactcaccctggacctgagagacctcttcaatcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56704 - DNA, 1854 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56705 - DNA, 911 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcaggtcagtgtgaaggtgggattagcccaggaccatgggtgggggtggcggaggaggggggctgggatatgagagggccaggtccgagtcgccctctcctggccccttctttctccacacccactcccatttcagtgcagggaaaggggtgtggcggcctttgctggggaaatggcggacgacaagtggggcggaggaggcctgcgtccggaaagtcagtagagtatgagaaatattttaaactcaagtgtctaaaattcacaaaaacagaaattgggacctgtgtcctcagttcatccactacactttcatttctccattgccgcctacctgtctttgcatttgtccttctgccagactctatcctctatcaccgtggagggaccactgacaacagaagacaagggaaaacgaaggaatttatctgactttggtagaggttaatgagagaaactgcccttaatctttgggggtggaggtctggtgtaggagactacctgagaggtactcacactgtcaccctcctagctatcatagcagagacccatctcctgcccttccctgtggacccaggaagagaaatgggggctcctgaggtcgatagaggaagacagaaaagaaaagaacaaagaaattgtatcctgttaatctgcctttatcaccaactcgaaatccaccctgtctgtgaggcacaaagccaaacatag

SEQ ID NO: 56706 - DNA, 1772 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcaaaaaa

SEQ ID NO: 56707 - DNA, 2318 bp, Homo sapiens
  misc_feature (8)..(8): n is a, c, g, or t
ggcacggncacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacccaatgctgacggcagcagccgaatgtcatccttatctggcggcgggggcggcggcggcgggggcagcggtggcggcggcggcggcggcggcgggaagaggtggcagccgggggggctgtggcggtcgcggccccggtcgtggcccggcccgcgcccgagtactccctcgtcgtcgtcctcctcatcgtcctcgtcggccgcctccacctcctcctcctcctccaaccaatatgactggtgttctcataagaggaagaaattttgacacagacatatatacagggaaatccatgtgaagacacatggagaaaacagccatctacaagatgaggagagagggctcagaagaaaccaaccctgctgacaccctgatcttggacttctggcctttagaatcataacaaaatccatttttattgttgaagccacccactctgtgatacactgctatggcagccctagcaaactaaaacagtgagtaaagagtatatgggtatactctatagcctatattgcaacttatttaaaatcctgaaattatttccaaacaaaaaagtgaattcctactgaacacattttgcacaccaggcattgtacag

SEQ ID NO: 56708 - DNA, 389 bp, Homo sapiens
cagagatcagaagatttttagggcagtaaaactattctgtatgataccataatgttacagatatgtcattatatatttgtcaaaattcacagaaggtacaacacagagtgaaccctatggattttggttgataatgatatgtcaatgttggtttattgattatatcaaatttaccataccaactggggctgttaatggtggaggagggagtatgtggaaactctcagtactttttgctcaatttttctgtgaatctagcactcttctaaaaaatcaagtctaataattacaaaacaaaagcaaaaaccatgtggtattggcatagggatagacatatagatcaattaatagaataaataaactgatacacttatgctctattgattttc

SEQ ID NO: 56709 - DNA, 954 bp, Homo sapiens
ttgaacccatgagttcaagaccagtctgggcaacatagcgagactccacctctaaaaatatatataagaataaaaaattttttttaaatgaagcatagtaagtacataaaccaataacatagtcactcactatgactatgaagtattatgtactgtatgtaattgtacgtgctgtgcatttatacagctggcagcacaataggtttgtgtacaccaagcatcaccacaaagatttgggtaatgcattccattgccctaacggggctacaacatcactaggcaataggaatctttcaggtccgttgttgtcttctgggacttctgtcatatatgtggtctgcctttgaccaaaatgttgttatgcagtgcgtgactatacccactatatgttcaagttctaaattggattctgggaagctgattaaagagaaaataatgtgtagtctattggaagaggtagataaacaatttttaagtgaaataattgctaatttttaacctctgtggaggcactgaactgatcattgaaagctctattttacttactaaagatatggtagcttataaaaattacttatagtaaatggacatgaaaaggtcatttgcttacatctctaaattcattttgatggaaaaatagtggaaaaatgtttgcagatacccttttgtttgtttgtttttttcataatagataattgccactaaaattgaagaatggccaggtccgttggctcatgcctgtaatcccagcactttgggaggccaaggcgggtggattacttaagctcaggagttcaagattaacctggccaacatggcaaaaccccgtctctactaaaaatacaaaaaattagccaggtgtggtggtgcacacgcctgttgtcccagctacttgggtgactgaggcatgagaatcacatgagcctgggaggcggaggttgcagtgagctgaga

SEQ ID NO: 56710 - DNA, 1404 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttacta

SEQ ID NO: 56711 - DNA, 4219 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgtatcacgagctattttggttttaggatgcaggtctcaaaagcaa

SEQ ID NO: 56712 - DNA, 4151 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgtatcacgagctattttggttttaggatgcaggtctcaaaagcaa

SEQ ID NO: 56713 - DNA, 3820 bp, Homo sapiens
  misc_feature (3804)..(3804): n is a, c, g, or t
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcataagctgtttncctgggggatcctctg

SEQ ID NO: 56714 - DNA, 3470 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgaccctccgtgaggcaggaaaatagtttgaacccgggaggttggaggttgcagtgagtcgaaatcgtgccacgggacttccagccggggtgacagagcgagactcccttttaaaaaaaaaaaaaacacaaaacacaaccctctcttctttccccgggcttgtgttacaagaattccccatttttgaaagggttttatcaaaaatttccccacgtggtttcttgggggaagccaccttcttttcaccaacaaagtttggggcgtttcaaccgggctggtataactcacggggtttttcttataccagttaccaagagcgtgtaaaaggccccttctcctggttggtgggggagtcttcctctaaatatgttatgtcgggaagtggcatgcggtacaccactggaagtagggggggaacttacacgaataagacccggaaactgtaacttcttaaaaagtcctttaaggtccattaaaaagttggcccgtgaatgttaaaggagtcggagctagtggt

SEQ ID NO: 56715 - DNA, 3935 bp, Homo sapiens
agaggtgaatggtactttgagaaaggcagttgcactggacggattgtatagagcctgaagaatggaaggagagcagcaagtgagataaggaatgaagacaatcttaaagtgtaccgtgaaggggtgttgagaaatggtgcagtaactggagggcttgtgggcttcatttgtaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56716 - DNA, 3876 bp, Homo sapiens
ggagcggcgtcagtgaggtgtcagaggaggcaaaccagaatgctgtggcctttaagccaagtgaagaaagcttcaagggaagagagatcagctgtgtcaaaaaagagttgggaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56717 - DNA, 4074 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagtgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56718 - DNA, 3900 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttaaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56719 - DNA, 3412 bp, Homo sapiens
ctactactactaaattcgcggcccgtcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56720 - DNA, 2027 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattatttttttactcctctgttttttttttttctctttt

SEQ ID NO: 56721 - DNA, 2020 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataatttttaaataaacggtgcttgtggggagcgg

SEQ ID NO: 56722 - DNA, 3234 bp, Homo sapiens
cggacgcgtgggtcgacccacgcgtccgtggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56723 - DNA, 684 bp, Homo sapiens
caagttctgtaatttatctactggatgcaaattatgtgcttaaatgtattgattaaacttttctttttccacagaactcaacaaaaatccagtggaaggcttttctgcaggtttaatagatgacaatgatctctaccgatgggaagtccttattattggccctccagatacactttagtaagtataatggaactgacatcttcaaaatggagctcttttaatacactgaattaaaaactattttggcaggctgggcacggtggctcacacctgtaatcccagcactttgggaggccaaggcgggccgatcatgaggtcaggagttcgagaccagcctggccaatgtagtgaaaccccatctctactaaaaatacaaaaattagctgggtgtggtggcatgcacctgtagtcccagctactcaggaggctgaggcaggagaatcacttgaactcaggaggcagagattgcagtgagctgagaccacgccattgcactccagcctgggtgacagagtgagactccatctcaaaacaaaacaaagcaaaaccacaaatattttggcaaactgacatgaaattattttttaaggagcaggagaaatggctgtattcaatatcctttgtactgaatttgatcatggaagagtttttgtgttttgcttgaagctctaatgtctaagacct

SEQ ID NO: 56724 - DNA, 240 bp, Homo sapiens
tgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcggtaaggtggtcacacgtcttcccttcccttcactttcccttgtaataaaacctgaactatagttagtatgtatgtaa

SEQ ID NO: 56725 - DNA, 4177 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56726 - DNA, 4123 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56727 - DNA, 3858 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatgtggaataacctcacaaacatgttaccttagtatgacaagtcaatctcatatggattttaaact

SEQ ID NO: 56728 - DNA, 3795 bp, Homo sapiens
attagccttcctccttcgctgcagctcctctaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56729 - DNA, 4079 bp, Homo sapiens
agcggggcggtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttattgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggtttttttttttccttttccaaagactgtaaaaatagttgccccaaaatgtcagcactgcacaccctccagggacttggaatacaatcctttttacttttttttttttttttttaaagaaacggggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacttgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 56730 - DNA, 469 bp, Homo sapiens
attgagtggttttattttaagtggtggaaaaaatgatgagaatctcctccagatgacagctccggaagtgtcgtgcctgaacccctctcacagtctggcgggcgcagagtctgtgagcggccaggaggccacctgctcgactggcccgtcctctccatgtgccagatgcagcccagcatgacactgccctcagctcaaaaacagcacagctactctgtgtgcaggaaaaaactgccagtgacttcaccaggatttgagaacggtccgtacgttcacactaagctgagacagcgcaggttagaagatagcgcggggaagtattcacacttcagatacgaccatcacggccacatggctaaggcccacaccctcccggggtgaaataactacagcagaagaatggggcgctaaccacctccacgggcattttaaataaaacccaaagttgttttgtttttttaaaaaaaaa

SEQ ID NO: 56731 - DNA, 1363 bp, Homo sapiens
gaattcagtaagctaaaatccaaagtaagcctctgatgataattggctcttattttatccatacggtcccaaagaacatctgctgtctttggcgcagggccatatatttgtggtttcaggtgcccctaaagtgtctataggagcctataaacaaagcctataaactgtgttgtaggaaagacagcacatattgttacaggctcatacaaagaaaatatatgtagtgtttcagtctagttcttaccttcctaagtagagtccttacacatgtgtaagggagataggtattgagaaagggagagtgggaatgtgaagtgatgcataacatgcaacttagtaggaattttgacctgtgttgggcacagcttgacaagcttgtgtgtgtgtatcaccacataccctcacttcccccttccctacctctttctccttactgacttcaagggagagcatataaatgacatcaaggggtatgaaaagccacttaactgcagacttgtaggcagcaactcaccctcaagaggaagtcttcaggctctagaaacatctttaacttcggcttctgcaccataagcctcagactcaatgccaccctgcagctgtgccagatcactttgtgccctgcaggtgctgctgttgactgttctgggttcctccaccaatggacaaactaagagaaacatagggaaaaggaaatgtagagatctgttccttgcacctgttgctgcttctgctatacctgtatctgggagaaagactggcttggtgctcctggggctggagagtgccattataacaacaaatccaagtggaggggtcacagagagggggcacttcacatttgctgggcattctgctgggcactttactaaagctttacagatcatattcacaatggctttatgagagaggtacaattaccttcaatttacaattgagagaactgagaaaaatattcacgaccactaatagatcactttttaccccagctgtaagtgtagacagtgacttgtacactgaactgcgctgcgtgtatgtgaagtcaacctttgtacttcatcccagaaacatccacaatttggagttggtctcagcaggaccccattgcagcaaagacgaagtaatgtaagccactgcttctgtcgtatcgcctcatcagggaagccctctacctccatccccatctgcattcatttcctccagtctcacagatcctttctgatattcaggccaggacacccacagataattctattctctcttgcagagccactctgtaagatgggagaaaaaatctgcctggacccagatgctcccagaatcaataaaattgtacagaaaatgttgaaagttgatgaattcc

SEQ ID NO: 56732 - DNA, 959 bp, Homo sapiens
ggactttagtagccatgaaggtcctcatccttgcctgcctggtggctcttgctcttgcaagggagaccatagaaagcctgtcaagcagtgaggaatctattacagaatacaagcagaaagttgagaaggttaaacatgaggaccagcagcaaggagaggatgaacaccaggataaaatctacccctctttccagccacagcctctgatctatccattcgttgaacctatcccctatggttttcttccacaaaacattctgcctcttgctcagcctgctgtggtgctgcctgtccctcagcctgaaataatggaagtccctaaagctaaagacactgtctacactaagggcagagtgatgcctgtccttaaatctccaacgatacccttttttgaccctcaaatcccaaaactcactgatcttgaaaatctgcatcttcctctgcctctgctccagcccttgatgcagcaggtccctcagcctattcctcagactcttgcacttccccctcagcccctgtggtctgttcctcagcccaaagtcctgcctatcccccagcaagtggtgccctaccctcagagagctgtgcctgttcaagcccttctgctcaaccaagaacttctacttaaccccacccaccagatctaccctgtgactcagccacttgccccagttcataaccccattagtgtctaagaagatttcaaagttaattttccctccttatttttgaattgactgagactggaaatatgatgccttttccgtctttgtatcacgttaccccaaattaagtatgtttgaatgagtttatatggaaaaaatgaactttgtccctttatttattttatatattatgtcattcatttatttgaaatttgactcatgaactatttacattttccaaatcttaattcaactagtaccacagaagttcaatactcatttggaaatgctaca

SEQ ID NO: 56733 - DNA, 3270 bp, Homo sapiens
gaagtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacatcgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagctcctggaagagctatctcaccagctccttcaggaccgagcaaagggggctcaggcctcgccgcctcccatagctccttaccccagccctacacgaaaggacctgcttctccacatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggccaggatgtcgccagcattaccttccactgcctttctccctgggaagcagcacagctgagactgggcaccaggccacctctgttgggacccacaggaaagagtgtggcagcaactgcctggctgacctttctatcttctctaggctcaggtactgctcctccatgcccatggctgggccgtggggagaagaagctctcatacgccttcccactccctctggtttataggacttcactccctagccaacaggagaggaggcctcctggggtttccccagggcagtaggtcaaacgacctcatcacagtcttccttcctcttcaagcgtttcatgttgaacacagctctctccgctcccttgtgatttctgagggtcaccactgccagcctcaggcaacatagagagcctcctgttctttctatgcttggtctgactgagcctaaagttgagaaaatgggtggccaaggccagtgccagtgtcttggggcccctttggctctccctcactctctgaggctccagctggtcctgggacatgcagccaggactgtgagtctgggcaggtccaaggcctgcaccttcaagaagtggaataaatgtggcctttgcttctgtt

SEQ ID NO: 56734 - DNA, 764 bp, Homo sapiens
gaagtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtgggaaatccggagagctggttgctgtgaaggtcttcaacactaccagctacctgcggccccgcgaggtgcaggtgagggagtttgaggtcctgcggaagctgaaccaccagaacatcgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtgggtgagcccctccctgtccctgcctccaccctcagaccagcggcaggcctgggacagatgctgacaggactcaggtgtctgactcctgctaatcattccatttaaaattccaacttaaaaattaaacctaaaaaagattgtacaccaatgt

SEQ ID NO: 56735 - DNA, 2849 bp, Homo sapiens
atcgcttaccgtacagttgcgaaggcggaggttaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagctcctggaagagctatctcaccagctccttcaggaccgagcaaagggggctcaggcctcgccgcctcccatagctccttaccccagccctacacgaaaggacctgcttctccacatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggccaggatgtcgccagcattaccttccactgcctttctccctgggaagcagcacagctgagactgggcaccaggccacctctgttgggacccacaggaaagagtgtggcagcaactgcctggctgacctttctatcttctctaggctcaggtactgctcctccatgcccatggctgggccgtggggagaagaagctctcatacgccttcccactccctctggtttataggacttcactccctagccaacaggagaggaggcctcctggggtttccccagggcagtaggtcaaacgacctcatcacagtcttccttcctcttcaagcgtttcatgttgaacacagctctctccgctcccttgtgatttctgagggtcaccactgccagcctcaggcaacatagagagcctcctgttctttctatgcttggtctgactgagcctaaagttgagaaaatgggtggccaaggccagtgccagtgtcttggggcccctttggctctccctcactctctgaggctccagctggtcctgggacatgcagccaggactgtgagtctgggcaggtccaaggcctgcaccttcaagaagtggaataaatgtggcctttgcttctgtt

SEQ ID NO: 56736 - DNA, 913 bp, Homo sapiens
tgagggtgctacaaggggagagctgaggacttgaatggctcagtgttcttgaaagctaattgtgctgggccctggagtgtggtctgcaggcctctccaacaggtgggcactgctagcctgtaccttttcttgtaggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggccaggatgtcgccagcattaccttccactgcctttctccctgggaagcagcacagctgagactgggcaccaggccacctctgttgggacccacaggaaagagtgtggcagcaactgcctggctgacctttctatcttctctaggctcaggtactgctcctccatgcccatggctgggccgtggggagaagaagctctcatacgccttcccactccctctggtttataggacttcactccctagccaacaggagaggaggcctcctggggtttccccagggcagtaggtcaaacgacctcatcacagtcttccttcctcttcaagcgtttcatgttgaacacagctctctccgctcccttgtgatttctgagggtcaccactgccagcctcaggcaacatagagagcctcctgttctttctatgcttggtctgactgagcctaaagttgagaaaatgggtggccaaggccagtgccagtgtcttggggcccctttggctctccctcactctctgaggctccagctggtcctgggacatgcagccaggactgtgagtctgggcaggtccaaggcctgcaccttcaagaagtggaataaatgtggcctttgcttctgtt

SEQ ID NO: 56737 - DNA, 1215 bp, Homo sapiens
gaagtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacatcgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagagcatctacaagctgacagacttcggcgctgcccgggagctggatgatgatgagaagttcgtctcggtctatgggactgaggagtacctgcatcccgacatgtatgaccgggcggtgcttcgaaagccccagcagaaagcgttcggggtaactgtggatctctggagcacttggagtcgcttgtcgt

SEQ ID NO: 56738 - DNA, 883 bp, Homo sapiens
gaagtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacatcgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtgggtgagcccctccctgtccctgcctccaccctcagaccagcggcaggcctgggacagatgctgacaggactcaggtgtctgactcctgctaatcattccatttaaaattccaacttaaaaattaaacctaaaaaagattgtacaccaatgt

SEQ ID NO: 56739 - DNA, 462 bp, Homo sapiens
atcgcttaccgtacagttgcgaaggcggaggttaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgaggatgagttcctggtggtgctgcgctgtgtgggtgagcccctccctgtccctgcctccaccctcagaccagcggcaggcctgggacagatgctgacaggactcaggtgtctgactcctgctaatcattccatttaaaattccaacttaaaaattaaacctaaaaaagattgtacaccaatgt

SEQ ID NO: 56740 - DNA, 282 bp, Homo sapiens
agggggtccaggagagtctcagcaaggtgggcatggcagaaggattctaggtgctctggggatgcaggctggggcgcttgttacccatgtcttcccctcctccagcactccccctacccagccacacataagctggctactaattgctgaccaaagtatggcttccctgcagctcctggaagagctatctcaccagctccttcaggaccgagcaaagggggctcaggcctcgccgcctcccatagctccttaccccagccctacacgaaaggacctgcttct

SEQ ID NO: 56741 - DNA, 2808 bp, Homo sapiens
gaagtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacatcgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagctcctggaagagctatctcaccagctccttcaggaccgagcaaagggggctcaggcctcgccgcctcccatagctccttaccccagccctacacgaaaggacctgcttctccacatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggccaggatgtcgccagcattaccttccactgccttttctccctcactctctgaggctccagctggtcctgggacatgcagccaggactgtgagtctgggcaggtccaaggcctgcaccttcaagaagtggaataaatgtggcctttgcttctgtt

SEQ ID NO: 56742 - DNA, 2067 bp, Homo sapiens
gaagtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacatcgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggtgaagagcctgaggcctggagagctaaaggactaacccaaggtcatgcagatagcaaatgccaggactaggactcgaacccatgtctcctgactccctgtggagatgtattgggtccagcctcaccctcttctgccgtcaaatttcccatgccttaaaatccatgaggaccggaatccatgaggaccccggaatccatgaggaccccggaatccatgaggaccccggaatccatgaggaccccggaatccatgaggaccccgga

SEQ ID NO: 56743 - DNA, 445 bp, Homo sapiens
tctgctccccaccacggctgtgtctaggatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccgtgagtagagccacctgggctggatctttctcctccccacattttcctctgagacaggagtttgcaatccaggccattggttacttttctttgtgggtgtttctttggggccacagggagcaggaggcagatgtgggttctaattctgcagacgcctctgagatgccacatgacgtgggctggtggcttgacctccctggggcttactggcatcctcagagctgtgg

SEQ ID NO: 56744 - DNA, 382 bp, Homo sapiens
atgagaagggctgaggcatttgagtatgggataaatacacctatgaacagggcaatattttcttcagagtggaagaaaaatagtagtattatacatgacatgtagaatttattttcacttattaaaaaatatgtgataaaacaacctcaattccacagttcatcttcatctatatttaatagcattaaatcatatcacttcctttaagaagcaatttgaaaaaaaaaatcccaactgaggcacacaacatgctcaatgtctgatatttcagtgaattcttggtcattgagtatttttcttaaaaccttcaaataatcacttgttaagacgtcttagaagctatctggagaagaagaaggtacttgttggaaaggtcacatag

SEQ ID NO: 56745 - DNA, 215 bp, Homo sapiens
gtaaacaaatcaattaacatgattatcccagacctttcttttcttactggaaaaaagagggcattaaactggatgatgacaataacaccataactacaagcttttataaaagtcctttatatacagtgttaatacagtgaaagatcaaccttattgaaagaggtctggcttctgccctcagctactgggaaacaatcactaggcctctggcatgt

SEQ ID NO: 56746 - DNA, 543 bp, Homo sapiens
gtgaatgaagtacttcatccaacaagtttttaaaaagctgggttttttaaaaataatgattacatgagaaatatgaggatttctcttgatgtaaaaagtttagttgacgcagagtagcaagtgaaaagcccttttatcttgtacccttttttctgcccccaccactgccccaagctctattggtagtttgatataaaacctttcatatcctcacttttgcatttattttgtgtatacatggagggggaggcatttacataaattgaatatagttattattctgtaacttactactttcatatcctcatttctgcacttattttatatatacatgggggggaggcatttacataaattgaatatagttgttattcaataacttaccttttcgcttattacatagaccttacaagctatgatcctgctctccttgtgtctatgacccaggtgggaagacacatcatctacaaggaaataattaagccacagcactgaccaatgtatcattcagagctaaaataagtgatactaacaccagggttt

SEQ ID NO: 56747 - DNA, 933 bp, Homo sapiens
acggcttccacatcaaggccagtgaagagcagaaatcagactggacccagatccacgctctccatccatttcctaatcctgtagctttcttgtatgctatctcctctagttacaaaagtctcatcccttgcatttctgcctcctgaaaccatatccacgttcatacccagttcaaatactactcttcaatttagctttgtctgtttatcctaataagcagttatctgtctcttcctatgaattcttatagcacttagttgtatagttctaatgatacttttatactgctttgtgttacatatgtaaatatacacatgtaaatgttagttacagagctactgtttctcagcttcaaagtcgccctctatactctgctttgtgaccctggggttgggactctgcgacccacattttttcctttgtagatggcttattaggctctgccaataaaggggtggtacaaagggcctagaaagctgtaagaggaagacgggacactcttctgtttgcttgctagttttgtttttgtttcctattgctgccagtgttgatcggcagctcttcttcaggtcatttgcagttcattatagtagccatagcagactccagtttgtagtttttctgacacagaaccagaatcatcatgcctctaagaaacgtcagcaccagccagccagcacccgcttttcagagtactgggccccagccctatggggttcttgctctcagctaaagatatcagtacctgcctgaggagcatacccttctgagaggttagagttttggctcccttcctccaagcttcttcccttctttgttctcccagttctacaagtagtatctgcttcttgcagttggtacctccataatacctaacttcctttgcatacctagttaacaattatttacattaaattctcttgttaaaaaaat

SEQ ID NO: 56748 - DNA, 336 bp, Homo sapiens
taaatctctatgtgtactttgcatttttactaaatgtactccaaggtgagccttgacacgtcaatggtaggaaaagattgcatactaaaccaaaacacgtaaaagcatggatctacttttaccatcgtgtttaaaatgtgagtcatgtagtgttagtctgctgtgaagttagcattgccaggatgaatcttctacagaaattgttacatttctggtttaatataaattaagaatttttctggtagtgcgtgaatgtttgtttcctgtctccttgcagattactagaacctttatttaggattccatcttgacttatttataatgttgttttgagtc

SEQ ID NO: 56749 - DNA, 118 bp, Homo sapiens
aggaagccgtcctctgaggaagtgatggttaagctgaaatctgaaataaaaacggagacaaacagttaaagaggtgagggaagatcatcaaggagattcaatggcatgtttgaagacc

SEQ ID NO: 56750 - DNA, 1047 bp, Homo sapiens
ggagcccgccagcaggtccaggtcagtaagttggtacaaagtggcgtaaccgtaggcagaaatccaggctgtcccatgtccattcacccttgcgattccgcgatcgcgagtagtgcccatgggccaggcctcttcgcaaattctgacaagggagtatagcgttacggtcacccaactcttgagctttggtgcactcctggggtttctcaggttatctggtgcatctgcctggacctcgtctagtttttgaccccttgatagacgcacctcggccagttgcctctggggctttcattatctttgtagttcttttttctctttttttgtatgtcttatgtgttcatttttttatcattgaatttattttattttaaagttatctatgtacaccaagtaaatacacacagggggttgcgcagtttggtttgtcttccacgctggcatgcaacattttggcagatgtgagtgggcaggccaggtgccccttgcagtgaccctggctctgaaagggatgcggtgaaggtggggagcaggaggaggaggaggatgtagtgtgaagcttctggtgaagggtttgcgtgtgtgttgtttcttttttatgtaagtgaattatatttcccttacatcttgctaaagagaaggctgctccctctgtgtcatctctctcctcatctgcgctacaccctcacatttccttatgtgtttttaaaagaaccatgtggtggcaacattacataaaaccccctggattcttaagtgccctgctgacagcaaatattagcctaagtccacaggcccacaggaaccttccttccaccctagtgggtctggagacagcatggcttgtctaccccaccgttgccctcttttccatgagttgcagctttagtgcagaggagccagattggacccccttcctcagaacaatggttttcaaactactccacagaatcctcagggtctcttaggactgttcaagggctcatttgctgaggagcctttgaacagtcagtcctaagagacgctgagacttcttccaccaaaaaa

SEQ ID NO: 56751 - DNA, 737 bp, Homo sapiens
ccagtctctttgaaattcctctattgaatctttgaatcttttaaataaagatcaaatttctctgcactgacttcagacaggagttctaacggagggcacgtggctcatgcacactgcgtgtttctccatcatcttttatagcggcaaccccacttccccagttgtttactttgagggcaatttccgtatcagtccaataggtacttgagagagagaagcccttttataaaatttagcttaggattaagccaaaaataccaccatgtgggggaagattcctgttccaaacactacctgtgtgtgtatccatgcacaaggctctcggcttccaactgccacgggggagttcacggcaaataccgtccattcccaagaagccagcattgatcactgtcgagcactgaggagattggaaacagggcgcagttgttattttagaagcaaactactccctttcctactgcctttcctaaggactctcttgtagttgggctttcctggggctatttcagttcttttgggccctctgaccaaaaaaaagttcatttaaattttcttttttcaaattttcaaatgacatttggagaaaagaggaggggagctgaggtaggacagtgtttgcctcaaagtaaaccactgaggagagtgggggtgccactataaaagatgatggagaaatacacccaagtgtgcactaatgagaatccacatcttcccccaaatccatatagaagagt

SEQ ID NO: 56752 - DNA, 249 bp, Homo sapiens
acaaggaatccatctgctgccattcccccaatccgctctgtcccagtctccaggctgcgaggggggccagtgtggtgtctgatgacgctgtaagtcatcctcagggacagctccaaaggtttagcatcacgtttgatccaaatgttcagaacgtctcacagatgggtgtcatttctgaaaacctgtaactgtaggctaaaattttctgatttagtttaaaaaaggaataaaaaagaataagcaaagaaa

SEQ ID NO: 56753 - DNA, 375 bp, Homo sapiens
ctcccgtaactttaaagaacagacatttgttcaaattcctaaatatgtttcaagaagactctattttcaattattcttacatttttgtggtatgtatgtgtgtcttttcctgagtaaagcatataaaattaattcatatatatttttatatatgaaattcctctggcttagttcctttgaagcactttttctcttttgtccatctcttttttgctttatacatttgctctcttactcttttgtcaacataaatcatttctcagattgggttcacataagcacttatgattgcaaaatgctacttgctagaatgaccactttggttgcctactgacctgggacaaggtagagcaaggcccaagattgacatttcac

SEQ ID NO: 56754 - DNA, 295 bp, Homo sapiens
ccgggcgtggtggcgcatgcctgtagtcccaactactcgggaggcagaagcaggagaatcgcttgaacctgggaggcggaggttgcggtgagccgagatagcgccactgcactccagcctgggtaacaagggggaaactccgtctcaaatacaaaaaaaaattatctccaattgtgttcctaaaacggtatttttgcacattagatttattaacatcatcataaacacggtgaaaccaaaatactggtaagatggggcggcgcttaaatcgatagtctacggagttacagaaaag

SEQ ID NO: 56755 - DNA, 369 bp, Homo sapiens
gccagattgtcttccttgcgagcccctgaccccggctactcttcaccagacacggccggctttggcccacaacacagccgccccacccctggatccttcaccttagcagtagcagtagctctgggtggagttgccagaggcagctgacaggccctctgccactgctgccacccccagggctagggagggaacaaagagcctgcttgctgtgcttgcacatccagcatgccacagctgcactacggagaggaggtcagacagtccccccaacaagcccccgatccctctgctctccaccagggagggccctgggcttgcgcccacagcacaaacgtcccatcccgggctgatcattctggttggcagcgg

SEQ ID NO: 56756 - DNA, 2079 bp, Homo sapiens
gaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatataagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatcaagtttgacatgttttcctgaattacttgtatgcattttctttaaggatttcccctccccattatatgatgcatgaatgatgtgccaaagtcagtcatttgaactaattatttgtgagaattttcatggaaaactggagcccattgctacttagtactctggaaaaaggaagtgagtaagaatacaataagaaaggaccaccaaataaatctcatggagaagaataatattatttcccaaaataatgtaagtttaaagaatttcatgacatttacaggcagaagatttaaatggaggaaaagaaatgtatttgtgtgagtgtgtgtgtgtgtgtgtgtgtgtgtgtagttaacatgtggagattgctgccagtgaatattataaaatcagtgatcttgccaaggtctaattagacactcgctaggatgaaactagttaaaatgactgttaattttaagggttcaagacatcagttgataactagatgaccttagaaacaaatgtctttcctcctgaaatattttccggaaaaaaaaattttctggaaaaaccttatcttaagagcttcagccacagttacagtgaagactcttactcctcactgaaagtctacagtgtgtaaggtacaactaacaaatttacgggaaacatgaattatgcaagagatgaaacgctggagtacaagttcttctgctgaaagttccatgtccccagatactgaaattaactttgataaactgaatcatattcactctgtttcaataatgttgctcgctgaatattcctgttgaacaattgttgcacattgatttgatcttttgttgtttccatcacctatataaaaataataaaatataaaaatcttctatttatat

SEQ ID NO: 56757 - DNA, 357 bp, Homo sapiens
actcaggttgtcatatatgctattgagaatagatttgtggtaaacatagaagtgtgggtatctttttgaaatcatgatttctttgtctttgggtagttacccagtagtgggattggtagaataaaggccagtactgtttctcattttttggaaagtctccatactgtttcccctctctctctctcttttttccttttttaactatactttaagttctgggatacatgtgcagaatgtgcaggtttgtcacataggtatacataggccatagtggtttgctgcacccaccaactcatcatctacaataggtatttctcctaatgctaacccctccagccccccactccccaacagtct

SEQ ID NO: 56758 - DNA, 130 bp, Homo sapiens
gcgggactggctggctctgcccagtgcaccatataacagcacggacaaaactacacaaatcccagctgggtacagtggctcacgcctgttttcccagcattgttcgaggctgcggtgggaggatcacttg

SEQ ID NO: 56759 - DNA, 579 bp, Homo sapiens
ccgccatggtgttccagggaaaccagcttccgagctgtacttcagagccctctgcaaacagtgctacctagacaaggtggggtcagaggctctcagataagcagaacttgcagggcttgtgacaggtatataacctagtccttaagccctgtgggattttacagcgctctgacggagtaactcgatggctaaacacggggagtaaagacagaaccatcccagcactcagggctccaccctccgagtaagcgagcttcccactccacatccttagcaacgctggcttcatcttccagaacggggcatgagaaaaccgacagaccagaattcttcacaaaagccgccttcacacagccaagagcataattccattaatatgccattttatagcccctcagtcatttcagatacaaactcagttactttcacatctattttaaacccacaaacaattcctcattggggatgaaatataaacaacaacaaaacccgctccagttatttagaaaatcagacactctattcttggcaaaggagatctacttaaaatacataaataaataaacatctaaaaataat

SEQ ID NO: 56760 - DNA, 647 bp, Homo sapiens
gagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcaatcccctacaagtggtgggggaaaagtagctccagctcaaccatctgaggaaggaccaggaaggaaagatgaaaataaagtagatgggatgaatgtcccaaaaggccaaactgggaactctagccgtggtccaggagactgagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttta

SEQ ID NO: 56761 - DNA, 833 bp, Homo sapiens
gattagctgccccagcagaatcaatgttgtctgggtgatgaacttatggttggattagccaatcttcctataaagcctccatagctggatccactatcagcataactaatatttgttatccatttagtgtacaacattgaacttgaaacagccaagggtaaatagtaactaaagttaacatgccattatacatgcaatttacaacttagaggagtacttaaagaaatacaaggaaaagctttccctctgccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttta

SEQ ID NO: 56762 - DNA, 203 bp, Homo sapiens
gaagtggggtgggggtggatgggggatggaggaagggccaggtgtggggcctgggaggaagcaaaggcttctgaagccaggaagcctggaatcagatgcaggtggggacaatgagtggctggatccccgagagtgtgtgcataaaagagcaaacgttgcaccaacagcctctgcgtgcctggtctctttctctgtgcgtgtgt

SEQ ID NO: 56763 - DNA, 343 bp, Homo sapiens
atcatttcataagcagacctttagtagacctggattagagttgccttcaggccccggactggaaccttggttttctgacttgcattatttcttctaccacactaatattctgttatttgaggcaaccacaattgcatattctgtctgcatgtgtgtgagtgtgtgtgtgtgagagagaaggaaaactagcaacagccatcctacactcctcttatcataacatatgtgtttcaatatttactttattatgagttttacaccttctgaaccagtgtacttaatacaaaagtaggaaaattcatctggaatgaaaaaaacaacagctacaacaaaaagtcacttt

SEQ ID NO: 56764 - DNA, 2754 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaatggagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagattataacaaagaaaacctaaaaacattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 56765 - DNA, 945 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggctttattgaggtgaagttgaaactaatctgcacacatgtaatatgtagaatgagttaacttcaccatcgagacaatgaagatattcacagccttcaacagatttggatgccccttggtaatcccttctatctgtccatgttctccaacctccccaaattccagataaacaattatctactttc

SEQ ID NO: 56766 - DNA, 878 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgagggtgctaaaggcattcacacccagtttgtggcttctgccctccagctaagatcgttccttagctgtccccaaatatgagaatgaatatacaatgataaaacaaaaataaatcaacca

SEQ ID NO: 56767 - DNA, 1223 bp, Homo sapiens
ccctacccattagccccaagatcatagaaaaatcttccaagctggaaactggttgacaatgatcctgactttcagtaggtgtgttttttaaactctgtatacctttttcctctacctgtgttgttatttgaatatgaagttgggagaagacatatcagagattcccaatctaatacgttttaaatttgacgtttttttcccttagactagcattaattgtgtttcacaacaaaacgagatagcatttcatctcacgggacagtacactagatttcatgaggtctcatattatttacagtaaaaagtttctttcataaacgcgcttttttcaagaacaatttaccatgatgatgtcttgaaaacacagaatttaggctctgccacaaatttgctttaacatgtaatgattcatcaagttttgttctccatatactattttagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggtatgaaaatacaagtgaggatatgtatttcatcagaaaacagaggctttccaagtttttctccccttgttcgtgctttttccttttctccttgatcagtgagacgtttcagttccttttcaaatttagcttcttcaccttggtctatcccaaccctataggacattcatggcttaatggattatccctctttaaattcatcacttcaatttgtctctgtctttgctgcctcctatttataaaaatgtttaaaatgtccccattg

SEQ ID NO: 56768 - DNA, 1721 bp, Homo sapiens
gagttcagtttttagatgaattaacttctcatttgtctcctaatattttcatttttcatcttctttcatgatttgttcttctgtttgtaaactgacagtaaatgtatataaaagctcagctctagacaatcctgatgtcaagtgtaattatgtgaaaatattttatttgataatttccatgatttatgtcaggtcatagataatatgattcagtataaatggcaccagcccaagatctacatttatcccagaaaaaaaaaaacctatttcctctctctgagtctcatctttaaaattctattattctataagctggatttaccttacaactagacccttactgaactttataaatatataaccagggagaacctgatacataaatatattcttatcatgaaatttattttactgattgcttaaatacaaaaaattgcttcttaaaggtttgagaattgaatgaaataattattctttacttacagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 56769 - DNA, 1022 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggggacctccctggctggcttagcctgtttgagacatcttttggagcagcacagccctctgcatctcagccaaatccttcatcatgccattgtctacactctgctctgcaacctcagaagctaggtctccctgtctgtccctactgtggccctgtggctggcctgctgaattccaactcagctccttcagtactcctcacagggcctgaagcaacttctagatcactttcaaggcatacagaattcaggagagatttgggcttgctaactcagttctgctgtctgcccaaccttgtcatgctaccattttcacattaatgttgccatccatgttggggtaagggatccctgtggggtgttttacttatagcatcctaaataagaagttagaaaaactcaaaaa

SEQ ID NO: 56770 - DNA, 198 bp, Homo sapiens
attgaatgtttactatgtaccaagcaatgttctaggttttggagatatatcagttaaacaatactatttcatgtctttatgggagttacatgccaacaaaggagaaacagataaaaaaataacaaaaataataaagaggtccatgttatagttgttcaaaagttaaaatatgtggaaaaaggtgacaaaaacaaacac

SEQ ID NO: 56771 - DNA, 261 bp, Homo sapiens
tgctcaagcaatcctcccactcagcctcccaagtagctgggactgcaggcgcatgccaccatgcccaactcagttagcaattttttaatccctagttttctggtgtgtaaagtaggaatagaaaagaatttatgtcatttgaggatttaacaaaatagtacatgtaaataaggctgttgggggctgggcatggtggctgacgcctgtaatcccaatactttgagaggccaaggtgggcagattactcgagcccaggagttc

SEQ ID NO: 56772 - DNA, 581 bp, Homo sapiens
ctgcaaactggaccagaacacgcatgctggcttacctcacccctagcatctcattgccccaggtgatgcttctctgcccttgctcttatttataacctcacactggggcccaccaagcaattcaattaattccctttctcgttgggcttggcatcaccacaggtgccatgatgggaatagccagcattggcacttactcctgaacctaccacagcctgtctctggaattggcccaagggatagaaacgactagttgctgtaacagagttacagtggcaagtcagttctctcgcagctatagttctcaaacatggtagaggtcttgacatgctggctgcagctcagggaggaacttggctgtgcttggagaagagtgctgatttgggttaagagatcagggcaggctcaggagcacatttgagatctcataaactaggcttctcacctttgggaaggggctactggggtgtcacctggttctgattctcatggctcctccccttcctgggacccctgacctctatcttccttcttctcttttctgggtcttgcttcttgaatctactaagtaagtttatttt

SEQ ID NO: 56773 - DNA, 451 bp, Homo sapiens
gcatacctatgtcctgcactagctatccacaaaggtcacattcattcaaacactactgagaactatggttttaccattacagttcccatccctagtgctgtcatcctcagaagaacctgatccctttagaaacaggaacaaaaagtctcaaagaatgtaccataagtatagtatatctgcaacatttacttctatttatttaagggttccagggaagaatcaagaaagagccattcagtttatacttttatcctgggctagcaaagtaccttaaaaaggaaccattaaattgaggctttgaatcaagttattctaataagttgcttgaaggtatattatgaaaataaatggcggggcacagtggctcacacttgtaatttcaacactttcagaagtcgaggtgggagaactgcttgagcccaggagttcaagaccaacctggccaacatag

SEQ ID NO: 56774 - DNA, 2684 bp, Homo sapiens
acatggatgggtgcaaaaaagagctgccccgcttgcaagagccggaggaggacgaggattgttacatccttaatgttcagtcaagcagtgatgacaccagtgggtcttctgtggccagaagagctccgaagagacaggcgagttgcatccttaatgtccagtcaaggagtggtgacaccagtgggtcttctgtggccagaagagctccgaagagacaggcgagctccgtggtagtgattgactctgattctgatgaggaatgtcacacccatgaagagaagaaagctaagttattggaaataaacagcgacgatgagagtccggagtgttgtcatgtgaagcctgccatccaggaacctccaatagttattagtgatgatgacaatgacgatgacaacggtaatgatttggaagttcccgacgacaacagtgatgattcagaagctcccgacgacaacagtgatgattcggaagctcctgacgacaacagtgatgattcggaagctcccgacgacaacagtgatgattcggaagctcccgacgacaatagtgatgattcggatgttcccgacgacaacagtgatgattcatccgacgacaacagtgatgattcatccgacgacaacagtgatgattcggatgttcccgacgacaagagtgatgattcggatgttcccgacgacagcagtgatgattcggatgttcccgacgacagcagtgatgattcggaagctcccgacgacagcagtgatgattcggaagctcccgacgacagcagtgatgattcggaagctcccgacgacagcagtgatgattcggaagctcccgacgacagcagtgatgattcggaagcttccgacgacagcagtgatgattcggaagcttccgacgacagcagtgatgattcggaagctcccgacgacaagagtgatgattcggatgttcccgaagacaagagtgatgattcggatgttcccgatgacaatagtgatgatttggaagttcctgtgccagcagaagatttgtgtaatgaaggccaaattgcttcagatgaagaagagctggttgaggctgctgctgctgtctcccagcatgattcatctgatgatgctggtgagcaggatcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactgctggcttatgcagcactggtgagatgtggtacccaaagtggcggcgctttgccaagatccagattggcttgaaagtctgcgactctgcagaccgaatccgggataccttgatccatgaaatgtgccatgctgcctcctggctgattgatggtatccatgattctcatggtgacgcatggaagtattatgccaggaaatccaacaggatacacccggagctgcccagggtcacccgttgccataactataagattaactacaaggtccattatgaatgtactggatgcaaaacgaggattggctgctacaccaaatcgttggacaccagccgcttcatctgtgccaaatgcaaggggtctctggtcatggtgccattaactcagaaagatgggacccgtattgtgccccacgtgtgaccatttgctgtgtatgtgcagaagtattatagaaaaattatgcaggagatggctaggattagccttggggatgtgatgaaaacacttggcaggaattacaaggcaatgaagaattcttaaggttatcttagagtatattaatgtgagctatatcctttactggtaagaagttttagaaaagtttgttttgtgaagttaggaatattagaatttaggtactgttaagtaagtaatgttagaatttaagattcatgttattaacgatgattgaccttaaatagggactctattgctaaccattctgtgcccttgacagggtatttctgaagcccttgggatctaccttgggtcttacttgagttccatatttttcacatgtagaacaaaatgcaaaagaaaagtgagttttcaagagtggcaggttgagagaggagaatgctggaaagaggacaagtttgagaggcaacacttaaacactagggctactgtggcatctatgtagacaggaaagacaaacgtgtttcataaaattcgttgttgatggtattgattgaaactatctgagccatgtaatcaaaaaataaaagttttctgcatcttgattgt

SEQ ID NO: 56775 - DNA, 2032 bp, Homo sapiens
acatggatgggtgcaaaaaagagctgccccgcttgcaagagccggaggaggacgaggattgttacatccttaatgttcagtcaagcagtgatgacaccagtgggtcttctgtggccagaagagctccgaagagacaggcgagttgcatccttaatgtccagtcaaggagtggtgacaccagtgggtcttctgtggccagaagagctccgaagagacaggcgagctccgtggtagtgattgactctgattctgatgaggaatgtcacacccatgaagagaagaaagctaagttattggaaataaacagcgacgatgagagtccggagtgttgtcatgtgaagcctgccatccaggaacctccaatagttattagtgatgatgacaatgacgatgacaacggtaatgatttggaagttcccgacgacaacagtgatgattcagaagctcccgacgacaacagtgatgattcggaagctcctgacgacaacagtgatgattcggaagctcccgacgacaacagtgatgattcggaagctcccgacgacaatagtgatgattcggatgttcccgacgacaacagtgatgattcatccgacgacaacagtgatgattcatccgacgacaacagtgatgattcggatgttcccgacgacaagagtgatgattcggatgttcccgacgacagcagtgatgattcggatgttcccgacgacagcagtgatgattcggaagctcccgacgacagcagtgatgattcggaagctcccgacgacagcagtgatgattcggaagctcccgacgacagcagtgatgattcggaagctcccgacgacagcagtgatgattcggaagcttccgacgacagcagtgatgattcggaagcttccgacgacagcagtgatgattcggaagctcccgacgacaagagtgatgattcggatgttcccgaagacaagagtgatgattcggatgttcccgatgacaatagtgatgatttggaagttcctgtgccagcagaagatttgtgtaatgaaggccaaattgcttcagatgaagaagagctggttgaggctgctgctgctgtctcccagcatgattcatctgatgatgctggtgagcaggatcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactgctggcttatgcagcactggtgagatgtggtacccaaagtggcggcgctttgccaagatccagattggcttgaaagtctgcgactctgcagaccgaatccgggataccttgatccatgaaatgtgccatgctgcctcctggctgattgatggtatccatgattctcatggtgacgcatggaagtattatgccaggaaatccaacaggatacacccggagctgcccagggtcacccgttgccataactataagattaactacaaggtccattatgaatgtactggatgcaaaacgaggtaagactcttctcagacttttcccagttacgttttgctggggcctccaagtggctcttcagtgattttataagt

SEQ ID NO: 56776 - DNA, 306 bp, Homo sapiens
gaaaatccccatgcacctaaccaccagccacactatagttgggtgagctggaaggtgtgagcatctgtaggtcctcagcccatgaagatgccctgcctgcctggtggtgggagacacagtggcctttatcacattctccataattggatatgagggaagcatgggaccgtgacccctggagggactgcagggattgcccacgccagtcatctcactgtacagctggagaaactgaagccaggacaaggagtgggccaaggttccatagtgagcaggggatgctctgtctgcctggtgcacaaccct

SEQ ID NO: 56777 - DNA, 734 bp, Homo sapiens
gttacagggtgcctggtatacaactttgggagttcccacaggtcctggcttagagatgaatatttctttctcagagaagtttgcaatttttgttagaatcataaacttccatttttgtatctatttagtctcccaaaattctgtagccaagttagattagaagtaggctttgtaaataaaaagagcgatttcaacccaaagtaagttctctaattctctctagtgaaagtctataattagtatagttgcacatgtgtatgtgtacgtattcaaatactgaatgctgttacaaaaatatcactgtatatattcgtagtattcaatcttagggtatagaccattttcttcaaatgaagttttacttgcaaattcacaggtaagaggagagaggacatagtctggttgaagaggggaaccataaatttacctcttccttgcacacctatctctgcagaatttctagagctctgtgttgcatagtttgaaaactgttgatctatagaatttcgatgaaatttttagcatctcttttcaaagtctgatgatttattcatacattatgactgataagacaagcttgtacttctgacattataaattaagtggaaagtatagtttcatatggctaaaggaagaaaatactgtcaagtgacattgatttgtgaatttagaatgataaaatctggttttattgtgagttaatctctcagtagaacatacctttaggaatgttt

SEQ ID NO: 56778 - DNA, 805 bp, Homo sapiens
tacttcttaaaatcttgagcgtcccctgacctaggaagacgaactctttcatctgagttcattgtgagccctagagagctgtgtgactatatcatcgtcatagccgtcattggactataaacgcattacaactccatctaacgtacctcattactcccaggaatattgggtgttagatcttgcaacacagcataaaacaatttatgttaaagaaggagcattatatcctaggcacttgagacaacctcaaaggtgatgttaccctatgaacagataggtggtacagtcaccgtagaaattcaagacagggatatagcaggtgatggcgattcatggattcagagtgggctagggactccactttattgttcgtgtatttctgagctgctaaccagcaaacctcacccataagcttaggtcaggatcatctgtcctcgggatgccatagagcctggtttcagaagcagaacaatcatgctaattaaaatgtcgtgttctggcctacagcagacaacagctggttttagattaagaaatctttttaaagaaacacatcttactggcctatagagaagacgaacttgaactggccctggcccaagtgcacactgagccactggctttgcccccaggggcctaactgggatgggcctgcttggaatgccagggctggaaatacttttttattttgctgattaacattacatagttgttaaaatgtttatctcatgtattttaccaaccctcacacatttaggtataaacctccttttctgggagaattaaagagaaaaacagcaacttt

SEQ ID NO: 56779 - DNA, 375 bp, Homo sapiens
actcttaagaaaagatcttttctgctggagttgctacaaaaacagactcatgaaaggttatcctgccacaaccagggaatcgcctccgtgaatgaatccaacagggagcacagcacagccagaagactgccaccaagacttaatggcatgatcggaacctcctgctccagatttccctggagctagttccacaatctgacttttcaacattatgagccaattaattcccctttatgactaagctggtcactcagaaccaacaagacctaaaatatggtgagctcagtattttaaggcaccgacactttagaagtgggctgtctgctctttgtgttaacaaggcaatatgaacacttcaaaccttttaagtcaaaa

SEQ ID NO: 56780 - DNA, 2875 bp, Homo sapiens
caaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagagactgatgtctggaccagtccccccttctgcttgttcccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgt

SEQ ID NO: 56781 - DNA, 2833 bp, Homo sapiens
caaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgt

SEQ ID NO: 56782 - DNA, 2658 bp, Homo sapiens
gtctgacttggagttttgtgctgttgcacgtgaatgctctggaactgccctaatcgactgaaaatgagccggctacagtcatatggaacagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgt

SEQ ID NO: 56783 - DNA, 2936 bp, Homo sapiens
ggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgccttctagaatcctaaagttgacctgaagccaagaagaaaattctggtgatgggagaagtggagccacttaaattacttacatgatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgt

SEQ ID NO: 56784 - DNA, 2625 bp, Homo sapiens
cagcctccgcagcctcgggccggatcgcccggcggggaagatgcgcctcaagaaccagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgt

SEQ ID NO: 56785 - DNA, 1847 bp, Homo sapiens
caaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagagactgatgtctggaccagtccccccttctgcttgttcccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaacaaatacatctatacagccaaacacaccacatagtgaatgattccattgggggtcgcg

SEQ ID NO: 56786 - DNA, 2669 bp, Homo sapiens
caacctttgggatgtgtgcatggtggcaaggggctgactgatatgagattacttcttttaagggaaattgtcattaatgagtcaagaaactgctcatttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgt

SEQ ID NO: 56787 - DNA, 2849 bp, Homo sapiens
ggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgt

SEQ ID NO: 56788 - DNA, 1167 bp, Homo sapiens
ggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccctaaccggcgctacccaggtccacttcaccaccaggctcagaggttcaggctggacaatttgcttaatatggcctatggcgtaaagaggtaattaaaactccacagattgccagatgtccatgttggcacagactggggctagaattttttttttttaattcactaactttactttaaaagaaaaaaattcttcctttttcttccacca

SEQ ID NO: 56789 - DNA, 309 bp, Homo sapiens
gtgggggatacatttgaagcccagagcatctaataaactaagaaaaatgaataataaaatatttgaataaaaaccaaattatatgtaatgttgatgactaaaatgtaaaatgacccaagcatgacatgttttatcactttatatgtatattttatcactttatatatagtgataaatacatatcattttatatatacacatgtacacacatatgtgtgtgtatatatgtgtgtgtgtgtgtatatatatatatgaaagcttgttacaaaaagattaaaagtgaattttgtgaaagtttaacacaatgta

SEQ ID NO: 56790 - DNA, 162 bp, Homo sapiens
gatgagatttcaattcctctgggtccgaagcatctccacatgacccaggcagagatgcagaaagaggctcaccaaagacaggccgacatgcaagaaattgccctttggcgcacagggcacattcgtgacaacacactcacacggacacacacacagagaaag

SEQ ID NO: 56791 - DNA, 217 bp, Homo sapiens
tcgaattcaagcttctaacgatgtacggggacatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaata

SEQ ID NO: 56792 - DNA, 287 bp, Homo sapiens
ctagaggatcccccaaaagtgcactcttctatatctaccaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatgggatggggaatgaccatgctgctagacggat

SEQ ID NO: 56793 - DNA, 336 bp, Homo sapiens
tagttttagaagtttcaatagcacctagttttagaagtttcaatagcacctaatcctacacatccaatgtggagagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctcaacttctaactagtctactgactcccactatg

SEQ ID NO: 56794 - DNA, 3004 bp, Homo sapiens
catacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaata

SEQ ID NO: 56795 - DNA, 3048 bp, Homo sapiens
catacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacaggagagaaagagagcaacttcagaagagcctttgctttgttacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaata

SEQ ID NO: 56796 - DNA, 3033 bp, Homo sapiens
catacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaataaaaaaacacaaagcataaaaacaaaacgg

SEQ ID NO: 56797 - DNA, 2586 bp, Homo sapiens
ttgactagcttcttacgtcattaaaaattctttaaatagtctgtcttaatggctgcaaattttgtcgtaagtctgggctaaaatctgatgaaatgttttacctgtggttaagtaatttagcaactcgtatctttttaaaatattacaactgggaattctagtacgtcacaaacatttgttatatcatttattttgtgccattgtctgtgctatgaaatacagtagaatgaaaatttacttcaaagcattcattgtcttcccccaggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaata

SEQ ID NO: 56798 - DNA, 2356 bp, Homo sapiens
catacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaataatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaata

SEQ ID NO: 56799 - DNA, 1622 bp, Homo sapiens
catacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatgggatggggaatgaccatgctgctagacggat

SEQ ID NO: 56800 - DNA, 1201 bp, Homo sapiens
catacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaaggtaaagggcaaaacaaatatttccctgcatcttccttgaggcgacataaaattttgttgtctcttgaattatcgatgctttacattgttaataataactttaacaggaaaaagcaaccattgtgtgcatgctatatggtgttaatagccatatttattgagtgcatactttgtgccaggcaccattctcagagctttgtgtatttactcatttactcacaaagccctatgagagagggatcctcattattattattcttactttgcagatgaaagggctgaggttaaagagagatagagtaacttgcccactctcacactgcttcttagtggtgggattggatataagcccaggctctggttccagaacccaagccttttactactgcaccatactggctggctaaatcaggacattggtactcacagctataactgacccactcccccacaaaaaacttttttgttgttattaacattttcccatgattttgcatttgcttatataagactagaagctgaagatttatgaaagaaatttaagatggaaaaacttggctggacactgtggctcacacctacaataccagcattttgggaggctgaggtgggaggatcacttgaggccaggagtttgagaccagcctgggcaacacagcaagaccactgctgtatttaaagaaaaaaggaaa

SEQ ID NO: 56801 - DNA, 1031 bp, Homo sapiens
catacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggtagtgtatatatatttgtctcttgagaagtagactcttttttcatttgtaattaatacagagcacatatacaaatacttttcttgagcttgagctctttaatatacttatgtcatagatttaagttggaagtaaaaatagaggcaattcaaatgactaatgacattggttatcatttcttgagcagctactgaggtcgggcactttgacatgacctcacttagaacaacttgagaacagaagatgtagcttatctggaattatccccattttataagtaatgacatggaagttcttagagttagtaaaagtttagctattaagaggcagagctgaaattcagaccca

SEQ ID NO: 56802 - DNA, 361 bp, Homo sapiens
tttctacagcagtataatcactacaaatccaatgtggagattttcaaattgcaaccaaataaacccagcaaagaactagcagagctggtgatgtttatggcacaggtaagaatataattgcttaaataaagaccagtattaacacacagtttgccgaatgttttttcactaatactcaaccttattccactctggaatgggaacttaattaaaatatttttctaactttccctttttgcaaattttattttctccctatcatgagttagagaatgtcactagatctttttgcataactaaccaggacaaaactttaagactattttttttcttcaaattcatcataaaagcaggtactaaa

SEQ ID NO: 56803 - DNA, 228 bp, Homo sapiens
ttccagttcgacaaataaagagaagaaaaaacagaagaactttatgatgatgcggtatagccagaatgtccggtcaaaaaataagcgttccttccgagaaaaacaggtgagttccacttgaagcttgggtggcaagaacagcactgtaattccaagacagctttacatttgagacggacttgcgccttctgaagactgggcattattgtgtgtgtcttgggagcattg

SEQ ID NO: 56804 - DNA, 477 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgagtgagtccgatccggcgggtgcctccaagggcggagggagggggtggggcagagctccctggaggtcgtagcctcgtatgtcccctgctg

SEQ ID NO: 56805 - DNA, 2086 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctccta

SEQ ID NO: 56806 - DNA, 2639 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56807 - DNA, 2546 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccaggtaggtggcctggttgtcccctcagtgcctgggcttccctgcttcttgcagccaaactgcaggcctctctgagcaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56808 - DNA, 2658 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56809 - DNA, 1981 bp, Homo sapiens
tattttattttttttagagatgggggtctcactatgtttcctaggctggtcttgaactcctgggttcaaatgatcctcccacctcagcctcccaaagtactgggattatagtgctggtgtaaaccactgcacctggccatggccaggattaaagggagaatgaccaaggtatattgaactcctatgcacccttcaataccctgttccatttacccttttgtagggccttgctgatgcttcagccaaaacccctgtcccctggccctgatgtactcctctgcctccattgtgatcacagggaccaagtgtatctgtgcctctatgactgggagtggagggggaattggtgagtattcaatgagtcatatctatgtaactatttatattggtttcaacagggctctgaagcagaagatctggcctggcatcccgagcccagagagcgagtttgaaggcctcttcaccacccacaagggtaacttccaggtaggtggcctggttgtcccctcagtgcctgggcttccctgcttcttgcagccaaactgcaggcctctctgagcaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56810 - DNA, 391 bp, Homo sapiens
ctgacgagagcggccacgtagtgttgcgctggctcccgccgcctgagacacccatgacgtctcacatccgctacgaggtggacgtctcggccggcaacggcgcagggagcgtacagagggtgaggccagcccctacggcccagcccccaaagctccactgactacggcccagccacgcctctcgaggtcgcgcccggtgccgctttcagggccggtccgtaacatcccacatcccattaccctggtgctgaagaccgttccacgcccacagacacaccccctttcctaatgtcctcgcaagcctgttgaaccccaacttcttctccctccggcccgtaaccctagacccctttagcgcccgggtccctctacgagtgctagcccagatatt

SEQ ID NO: 56811 - DNA, 2451 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56812 - DNA, 2555 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56813 - DNA, 2734 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccaggtaggtggcctggttgtcccctcagtgcctgggcttccctgcttcttgcagccaaactgcaggcctctctgagcaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56814 - DNA, 1886 bp, Homo sapiens
tattttattttttttagagatgggggtctcactatgtttcctaggctggtcttgaactcctgggttcaaatgatcctcccacctcagcctcccaaagtactgggattatagtgctggtgtaaaccactgcacctggccatggccaggattaaagggagaatgaccaaggtatattgaactcctatgcacccttcaataccctgttccatttacccttttgtagggccttgctgatgcttcagccaaaacccctgtcccctggccctgatgtactcctctgcctccattgtgatcacagggaccaagtgtatctgtgcctctatgactgggagtggagggggaattggtgagtattcaatgagtcatatctatgtaactatttatattggtttcaacagggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 56815 - DNA, 1983 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacactatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctccta

SEQ ID NO: 56816 - DNA, 702 bp, Homo sapiens
aagtcggcactagcctggaaaacaaacacaaacactgggttctccctccaccacagtaaactatgccatgtcagatacagagatagagatttaaaagggcctcaaattcttcacagctcatcttatcaaggatagcacctgtctctccacccctgaatctaggtgggccttttttgaccaatagaatgtggcaaacatggtgttaggtgagttctggggcctaggcagcccctcactcttcctcttggcacagtgcaggcaagacagacagacgagagctcatgagagagacacgcaactggcagtcagcaccagagccccgacacctgtcaatggaggccgttccagaccctccgcccacccaagcctcctggtgggctgcagcgacctggagttgaactccagggagcccagcgcaacagcctgttcccagcccagcccaaaccaaaggtctgtgagcaaagaagcggttttttgtttgtttgtttgttttttaaagacaaggtctccctctatccccctggctgaagtgcggtggtgcaaacacaactcaccgcagcctcagctccggggctcaagcgatcctccagcctcagtctcccaagtagctgctgaggcaggagaatggcaggaacctgggaggtggagcttgcagtgagctgagatcgcaccactgcactccacagagccagatgccgtctc

SEQ ID NO: 56817 - DNA, 387 bp, Homo sapiens
aaaaatacttactcattaataggagatataaattaaagagatgcttaggaataggagaattccaactaaaaatttttaagccacacaaaaatctttcctttaaaaaagtgttcatcactcattcatgatttgacctttgaaagttgctatttgtttcatatacactaatgatttaacagttctctagggtcttaaattagtaaaccattaccagacttgcaagtgtaatgggtcagaattcctactcctgttttattggtaaggaaccaaaactatattaaatttaaatatatcatagtcataggtttttagtgctgacaccaatgtggctaaacctagtactctgaggctcatatattgaaagccatgagtactcagaatctaatt

SEQ ID NO: 56818 - DNA, 255 bp, Homo sapiens
ctcctaatctgatgggtaagggaggcaaatgtgtaaacaattaaaatccagttgagatgatggaggagtttgagcataacaaagagggaggggctatgtgtgttcatgcggctgggtgtgtgggtgcaattccttagatatttacagatgcggcttctgtgccaggcctttctgtgtgctgtgccctcagccaggaatgcctggttctgctggctaacctcacatcatgtctgtccctgcgatctccaccatagg

SEQ ID NO: 56819 - DNA, 319 bp, Homo sapiens
aatatcattactaatgtttggaggttccccaccccaaggatttccctttccatttctatcaagtttcagcagatccttttctgaagtttaagtaagacaagcggcttgcctgttccatatcaatttgacttggaatttagaagctaacccttcctcctcttcctcttcattttccttactttactagcctcatctcccttgttttactttcttctcaagttctttttttccatgctttaagtattaatttaaaagctcccctttcctatgctctaagaaaaaagaatagcagaaggaacagaagacaggtttagaaggg

SEQ ID NO: 56820 - DNA, 327 bp, Homo sapiens
aaaagacagggtcctcactctgttgcccaggctggtcttgaactcctggactcaagggatcctcccgccttggcctcccaaagtgttaggattacaagcgtgagccaccgcacctggccctttaagttgaattcattttgttgtttgatggggcaagggtgtgaaagaaatttccgattacatatagaggagctgagaaatacttcttttttgtttttttgagagacaggttttgctcttgttgcccagtgcagtgatgtgaacatagctcactgtaaccttgaattccttcctgggctcaagcgatcctcctacgtctcagcctct

SEQ ID NO: 56821 - DNA, 347 bp, Homo sapiens
ggcaatgaatcatgcaaaatactggagaattttgattgcgagctcagcatcaggtagaagtgtaaaattaattctgaaacattaatgtaaactgtgtctgcatgaatatagagatagcaccagaatagcagcactgaaggaaatagtctcattgtactctcttagattatattatgaaatttgtgcttaattctggatataacattttaaaagcagtagagagtggcaaacggaaacagattagaataacaagaatagtaaattttatgtggttatgaaatatgaagaaaagttgaaaaaatggctgcctatgccagaataaaattaaggcatgacaataactgtca

SEQ ID NO: 56822 - DNA, 362 bp, Homo sapiens
tttggtggttgcatttatagatgatctatgtgtagcagcatcagaaaagggacaggttgtcgttcccttcaccactcctgccttggactacaaaaccctggaccaaaccatcaccagctgtctcctggacatagaacagttttcaactactgtccccaaatctattcttgccctcctggaccctctactgtgctgcagctagtatgatcagaaaagacagggaagagttaccagtccccaggaaaagctgtggctgtaggaaagggctctctgccaggagcccctgagtggaatcaatgaaggagtaggcctgcagtagaatgaatgaatgaatgaatgaataaagaataaataccgcagcc

SEQ ID NO: 56823 - DNA, 871 bp, Homo sapiens
aggagattctttttgtcttgtttttgtcatggagtctgcactccagcctaggtgacaagaatgagactccgtcttaaaacaaaaacaacatatttgttcacttttgaaccctgtggtgtcttttaactttgttaagggcccttggttagcaaaattatgaaagtttaggaaatttggctattgagtatattaagtacaactacaaaatcctctgagttctccaggaagcctaaaccttgagcagtatcttattcaagtggagtatatatcttcaagaatacagatttttaaggtaagtagtttttcgtctttgcatctcctaagaccattgttaacaaccttgatattaaacgaagaagtgaatgtaaacctccttttgaacatattttttataaagaaatattttgttaattggagtaagtagtattgttatgaaatcactgtgtaattgttaattgtaaactgcaatgtctattttgtgttgtaacaatgttgccataaaatagctttgctaaatgtgaaatgactttaatcccttttgtcttcaatatacttcataaaggaggaaatgatgatttacacaatttgtcatgaagcttccgtgtttatgagaaattccaagaagtaagagccaagaggacagatattatcagaatatgggacataagaaattgcatatagtgtcaagggtttctatataacaacttaatttatttcccttgcatatatagtaggggttaacattttgctcaatgttaacgggggacataatggacataaaacattggatagctttttatttaaatgagctaaaggtgtgcgtatacacatgcacttataaaattaaagtcatatatgtatatacaaaaga

SEQ ID NO: 56824 - DNA, 1036 bp, Homo sapiens
ctgacatacttgttgctaattttgagatctgggcaacaactgtgtaggctgttctttcaacctctttcttcttacttctttacttttccttcagagaggagaaagccacccctgtgctatagccaccgctccaattctgactctagctaggtcatgaaacagactgagctattattgcatcaacacataaatcctgtcatttgggtattattctttagagaactagagattacctagctgcaacctaagtttcctgaattagaatcatttgagcagcatcatcttattggctcattaacatatttgtgaccaggcacagtggcgcatgcctgtaatcccagcactttgggaggccgaggcgggcggatctcttgaggtcgggagtttgagaccagcgtggccaacatggtgaaaccccatttctactaaaaatgtaaaaattggctgggcttggtggcgcgcgcctgtggtcccagctactcggaaggctgaggtgtgagaatcacttaaacccgggagatggaggttgcagtgagcagagattgcgccactgcactccagcctaggtgacaagaatgagactccgtcttaaaacaaaaacaacatatttgttcacttttgaaccctgtggtgtcttttaactttgttaagggcccttggttagcaaaattatgaaagtttaggaaatttggctattgagtatattaagtacaactacaaaatcctctgagttctccaggaagcctaaaccttgagcagtatcttattcaagtggagtatatatcttcaagaatacagatttttaaggtaagtagtttttcgtctttgcatctcctaagaccattgttaacaaccttgatattaaacgaagaagtgaatgtaaacctccttttgaacatattttttataaagaaatattttgttaattggagtaagtagtattgttatgaaatcactgtgtaattgttaattgtaaactgcaatgtctattttgtgttgtaacaatgttgccataaaatagctttgctaaatgtga

SEQ ID NO: 56825 - DNA, 521 bp, Homo sapiens
aggagattctttttgtcttgtttttgtcatggagtctgcactccagcctaggtgacaagaatgagactccgtcttaaaacaaaaacaacatatttgttcacttttgaaccctgtggtgtcttttaactttgttaagggcccttggttagcaaaattatgaaagtttaggaaatttggctattgagtatattaagtacaactacaaaatcctctgagttctccaggaagcctaaaccttgagcagtatcttattcaagtggagtatatatcttcaagaatacagatttttaaggtaagtagtttttcgtctttgcatctcctaagaccattgttaacaaccttgatattaaacgaagaagtgaatgtaaacctccttttgaacatattttttataaagaaatattttgttaattggagtaagtagtattgttatgaaatcactgtgtaattgttaattgtaaactgcaatgtctattttgtgttgtaacaatgttgccataaaatagctttgctaaatgtga

SEQ ID NO: 56826 - DNA, 1386 bp, Homo sapiens
ctgacatacttgttgctaattttgagatctgggcaacaactgtgtaggctgttctttcaacctctttcttcttacttctttacttttccttcagagaggagaaagccacccctgtgctatagccaccgctccaattctgactctagctaggtcatgaaacagactgagctattattgcatcaacacataaatcctgtcatttgggtattattctttagagaactagagattacctagctgcaacctaagtttcctgaattagaatcatttgagcagcatcatcttattggctcattaacatatttgtgaccaggcacagtggcgcatgcctgtaatcccagcactttgggaggccgaggcgggcggatctcttgaggtcgggagtttgagaccagcgtggccaacatggtgaaaccccatttctactaaaaatgtaaaaattggctgggcttggtggcgcgcgcctgtggtcccagctactcggaaggctgaggtgtgagaatcacttaaacccgggagatggaggttgcagtgagcagagattgcgccactgcactccagcctaggtgacaagaatgagactccgtcttaaaacaaaaacaacatatttgttcacttttgaaccctgtggtgtcttttaactttgttaagggcccttggttagcaaaattatgaaagtttaggaaatttggctattgagtatattaagtacaactacaaaatcctctgagttctccaggaagcctaaaccttgagcagtatcttattcaagtggagtatatatcttcaagaatacagatttttaaggtaagtagtttttcgtctttgcatctcctaagaccattgttaacaaccttgatattaaacgaagaagtgaatgtaaacctccttttgaacatattttttataaagaaatattttgttaattggagtaagtagtattgttatgaaatcactgtgtaattgttaattgtaaactgcaatgtctattttgtgttgtaacaatgttgccataaaatagctttgctaaatgtgaaatgactttaatcccttttgtcttcaatatacttcataaaggaggaaatgatgatttacacaatttgtcatgaagcttccgtgtttatgagaaattccaagaagtaagagccaagaggacagatattatcagaatatgggacataagaaattgcatatagtgtcaagggtttctatataacaacttaatttatttcccttgcatatatagtaggggttaacattttgctcaatgttaacgggggacataatggacataaaacattggatagctttttatttaaatgagctaaaggtgtgcgtatacacatgcacttataaaattaaagtcatatatgtatatacaaaaga

SEQ ID NO: 56827 - DNA, 169 bp, Homo sapiens
cagattcagagtaagggcctgcttcctcacagacagctttgttctcactgtaaccttatatggcagaaggagcagaaagaaggggcatatgcaatctctatgcaatctcttttataaggacactaatctcagggggattctgtcttcttgacttaatcacctcccaaag

SEQ ID NO: 56828 - DNA, 314 bp, Homo sapiens
aaaaatggttatgacagagcagataatcagaatgagtcagggtagagtaggaaatcagagtgagtcagggtggagaagagtcagggtggagtaggtaatcggaaaaggttgctttacgtggaagttaagtttaaaagcagaaggcaaagaattgaacatacatattaattctttgaagagaaatttataactcatatttaataacttcctcctcttgcatttttccttatagctttttctttaactcctttaacatgtcttggcttagttgttctgcctgattttccaaaagaaggagcttctctggttaaggt

SEQ ID NO: 56829 - DNA, 540 bp, Homo sapiens
ctccgttagactaagctccgcgaggggtgagaaagttgttccgtccactcgtcctccggggctagcaggacatattctgtattaaatgagtagatgacagaaaccccgtgagagaaagagtgagccgagccagtggttctctaagtgtggctccaggaccagcggaccagcagctcagcatcgcctgaggatttgttagaaatgcaaattctctgacttggttgggggacccagcaatccgggtttgaaagaactgtccaaggggggattcctgtgcacactgaagtttgagaaccaccgaaggcggcaaatcccctgctgttgggtgagtgtgcactgtggcagctttggtgacctgtaagaggaaccatggatgagcaaaccccaccttcaaatgtagcaaagggcagagagagggtggacacgtcacccagacccccaaaaggggcccagacgtgttgttcggcgagctggccactggagggcagtgtggccacgtccatcgtgctgcctccgagggcttccgggggagagcggccg

SEQ ID NO: 56830 - DNA, 2832 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56831 - DNA, 975 bp, Homo sapiens
tggcgtccctggtctaggcggagaaccccttgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56832 - DNA, 313 bp, Homo sapiens
aagtgatctaaataatttatttgggaaaatgtatgggttctgtgggaaatagctgaaggcatttgggttcttatgtaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctatgagtcaagggtcttccaaggctttcgataatgaaatcaggattgactgtccttcccgcagccgggggagtggaaacctgagcctggagagt

SEQ ID NO: 56833 - DNA, 3321 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggaggtaggtggtggtcgtccccggtcccaggaaggcaggggccccgctcccccacgggaccctcgacatggaccattccgcgttcgcaaccgcggggagcgggcgaatccattatgtggggcgggggtgaaccgtgggtctggggccgcggggtggtgggagcggtgcgagggaaaccctgcactctgagctggattgggtcgcgtgcgatgtgcgggctcctggcagaccctggggttccgctgctcgttgccatggctcccgccggagcggccagagcgggcgtcgggttgggtgtcagcggtattccgggcccggttctccacccaggcctggacctggaccctcgggcactgcagcgtccgtctgtaggtttccaggcagaggaaatcctgagacatccaggcgcagctgggagttgctacctggctccatccgtgagcacagcgaggtgctgtctttcatgcttatctgtcttcctcttgaattcagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56834 - DNA, 3244 bp, Homo sapiens
  misc_feature (2843)..(2843): n is a, c, g, or t
  misc_feature (2848)..(2848): n is a, c, g, or t
  misc_feature (2850)..(2851): n is a, c, g, or t
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaaaaaaaaaacnaacancnncacaaacaacgaaacacacacaacgacaaaaaaaccacacagacaacgaaaaacagaaaaaacctacaagaacaacacaacagcaggcgacaaacgaaaaaagcccagggaagaagactccaacacaaaccaccgacatgacaaaaagacacacaaagaagaaacacaaggaacacagaacaccgacagacaagaccacgcgggcgaaaacggcctcacccaccgccacgaggagagcgacaacacacagccggggcgcaacaaatggagcagccacaccacagagacaagcaacgcgacacgggacacaaacccagggcagacacggacaaaccagcccggacccgggggaacgaaggcgcagaagacaaaaatcgaggcaaaaacacacca

SEQ ID NO: 56835 - DNA, 2935 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggtgaggcttcccctggttgccttggcagcagatggtgctgagcaggcattggctggcctgggagcagggcctgctgcttggctaccaatatgtgcttttgcaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56836 - DNA, 3368 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagaggtgagtgtcgagaacatggcccagtcactgatttttgtggcagacttttttttttttaacaggccgaagttgagcattggaaagttaaagacagcagagatgcttctgactgcagtagggtagtgcttctcaaacctgggtaggccattgcccaagtatgggtgacacaatagggcattcaagtcactggggaaatatggcctcttttcctggaccattttatttgaaggtatgggggaacgaaaaaaatactattatggagtgcagtgcacagtttgcatgaactctaaaagataaagcaagaaatatcaagtaggttttgcacattgggctgctttaggctgtgccctctgattcttctggtgtactcatgatactctcccttggtgccctccaggctgacgcagctatttacgttcagagtgaaatgggctgtgtggctgggattgggaaaggccttgttaaagctgggagaggtttggtcatggtgacaggggacctgaaggcccagctcctcttccctcttgccaatacagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56837 - DNA, 2686 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56838 - DNA, 2501 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccaggcagcaatgtgctattgaaacttctaaaactagg

SEQ ID NO: 56839 - DNA, 2170 bp, Homo sapiens
  misc_feature (2146)..(2146): n is a, c, g, or t
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatggagataggaataataaacggcgcgggggcncagggcaggttcttcatacagggg

SEQ ID NO: 56840 - DNA, 1434 bp, Homo sapiens
gaagtggatttgggccatgttccaggcatgaatgaggcagtgtttctgccagtggtgtcctggggatggactaggacctggtttggccatgcccagggagatccgctgaagctcattgatttgtttttcattcattaattccaatcaagtaaccaattgctgtggctgggtctggagagggcatggctgaagccaccacagtgaatgggagaaagcagtgttggggattggtggtggatactgtcctctggtcttcctcccttgccccttttgggtgggtatctttggatttgtcttcctcctgtcctgaggccgtggggtcctgtcttccctcctcaagtctaagcctggcttgttctctggcaggtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56841 - DNA, 2312 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtgagttttggtggtaccttgtggggataagatggtgacccataagcttaagggaccagaagatttctggacatttctcaggtcccagcattagctactgacccagaatgggagagtgacctccaatgaggtgatatacgaaaatgttttggaaattgtcaagggctttgtaagtgcaagacatattttgaagtcggaaaagtatagtgggatctatggccataccgccctgaatgtgccagttggggctggttcgtagttggatgaggagagaatgggaatgagctggtgcttgccacttacttgctgggggttgtcgagtaagtcattgaatctcaatttcctcatcagtagaaatgcagtagtacccctgctaaattggttaagactttttgttagcagtgtcagaaatgtgattcactctcactttaaaagggaacatataaaagggaatttcataagttcatattactgcggagtctggggatttaattggcttcagacactactggattcaggcgctcaaatctatttcttccgatttcctt

SEQ ID NO: 56842 - DNA, 959 bp, Homo sapiens
  misc_feature (7)..(7): n is a, c, g, or t
  misc_feature (11)..(11): n is a, c, g, or t
aattcgnggcngcgtcgacaagtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56843 - DNA, 1121 bp, Homo sapiens
tggcgtccctggtctaggcggagaaccccttgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56844 - DNA, 1533 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttatgttcagagtcaacgaaatgtcctcgtccttggagaagaggagatcaggaagtggtagcgagtatggcatagcactgtttgattaaa

SEQ ID NO: 56845 - DNA, 1010 bp, Homo sapiens
  misc_feature (949)..(949): n is a, c, g, or t
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatcttgtagtcaagntcttgccatgcaggtgcagaaaggtgggcctcggccgattaaccccggctctactgagcca

SEQ ID NO: 56846 - DNA, 494 bp, Homo sapiens
gcactacctctctggtaacatggtgcatgtcccctcacagggaggagtacgggaaactgtttgattttgtcaacgcgaaaaagctcaacatcaaaaaccgaggattgaaagaggtacttctgtgtggggaggatgagaccctctcctggtctttctataggggagaaaggggtggagattttttccggcttctttttcactctttcttctcttcttacccttatagaaaaaagaggtgcgtgtgaccctttccccctcctggtgcaggtttcctctgcatgaccttagaccagtctatgcagcccctcaggagcccccagtggggctgggagagggaggggcttggggcttggactaacccagttggcaggaagtacttgggcataggccctgcacgttggctgtgtgtggacaatccagccccaggtcttctgggagctgctgctctgacttgacaggcatgggggtgtgcttttgagtgtgcagggattctg

SEQ ID NO: 56847 - DNA, 567 bp, Homo sapiens
gcgcctctgtcagaacagctcagtgaggtttacttagtcgaggacatgagcactcgtgtcgctgctgctagatacgccctttgcctctgctgaggttggcactaaccaggctccctgcaccctctgtcaggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagaggtgagaacctccacctgtcacttcctgggcatcctggtcccgagccagctttgtctaggaaggctggcgtggcctggggcactctccaaccctagagcagaatttttcttttgctacatcaggatttggtccttttccctggagtgctcagactttagaaacctctccattgctttctttctggtcattaaaaaaacaaaacaaaacaaaacaaa

SEQ ID NO: 56848 - DNA, 2227 bp, Homo sapiens
cggtaccccctggctctgaacttaggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56849 - DNA, 3253 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaaaaaaaaaaaaaaaaaaaaaaaaaaaaaaaaaaaaaaaaaaaaaaaaaaaaaaaaaaaaaaaaagagggggggggcggcgccccaaagaaatccccccgggggggcgccccagggcgacgcccccccgttttgggcgagagagagggggccccccataggggaagaggcgcataataaatagaggcagagaaccggcgggcgcgcgcggattataaacacaagccaggacggagggagggagagaaaacaacgcgtcgcgagtggggagaagccattcttggtgagaagaagagacacccaacaacgatgaggggggggggggaaacaaaagtgtgggggacaccaacaccacaccgcgacagaagaaaaattaaacagcacgccggcggggaagaagcgagaaactctgcagagcgagta

SEQ ID NO: 56850 - DNA, 2854 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctact

SEQ ID NO: 56851 - DNA, 1763 bp, Homo sapiens
tagatgagtcggtaccaacatgcgaacggactgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56852 - DNA, 1325 bp, Homo sapiens
cccacgcgtccgcgacccacgcgtccgcggacgcgtgggtcgacccacgcgtccgaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56853 - DNA, 1916 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggacttgaggcacgcctccttggtcaggtaattattgctgtttccgtcacagcccccatacacaaacagctggcaggagccgtcagtgacatgtaccatcaccatagcatggaggcccggcatcgcccagcatcagccgggatcctgtagagtca

SEQ ID NO: 56854 - DNA, 1137 bp, Homo sapiens
ttggatgtgttcttgatttccttgatcagcttcactttgtccactggcttcgcctcggtcaggcggaccgcgtgaacatgtgtccgttctttcgctatggggtttcttcttccaccgcctcctggtctgctgcagcatgtacagcccctgatatcacaccacccatcggcactagcccaacatcctggatcttcaacgttttcttcaggagctcgttgaggtctgagatttccaagagagtgaggctggcgatgtcctggaccagctgctgtatcttgtggtccgagcggaccggtccgctcggaccatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56855 - DNA, 1853 bp, Homo sapiens
tagggctatcgtcgaccagcgtcgcgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagaggtgagtgtcgagaacatggcccagtcactgatttttgtggcagacttttttttttttaacaggccgaagttgagcattggaaagttaaagacagcagagatgcttctgactgcagtagggtagtgcttctcaaacctgggtaggccattgcccaagtatgggtgacacaatagggcattcaagtcactggggaaatatggcctcttttcctggaccattttatttgaaggtatgggggaacgaaaaaaatactattatggagtgcagtgcacagtttgcatgaactctaaaagataaagcaagaaatatcaagtaggttttgcacattgggctgctttaggctgtgccctctgattcttctggtgtactcatgatactctcccttggtgccctccaggctgacgcagctatttacgttcagagtgaaatgggctgtgtggctgggattgggaaaggccttgttaaagctgggagaggtttggtcatggtgacaggggacctgaaggcccagctcctcttccctcttgccaatacagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaa

SEQ ID NO: 56856 - DNA, 1705 bp, Homo sapiens
cctctctgtgaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaaaaaaaaaaaaaaaaaaaaaaaaaaaaaaaaaaaaaaaaaaaaaaaaaaaaaaaaaaaaaaaaagagggggggggcggcgccccaaagaaatccccccgggggggcgccccagggcgacgcccccccgttttgggcgagagagagggggccccccataggggaagaggcgcataataaatagaggcagagaaccggcgggcgcgcgcggattataaacacaagccaggacggagggagggagagaaaacaacgcgtcgcgagtggggagaagccattcttggtgagaagaagagacacccaacaacgatgaggggggggggggaaacaaaagtgtgggggacaccaacaccacaccgcgacagaagaaaaattaaacagcacgccggcggggaagaagcgagaaactctgcagagcgagta

SEQ ID NO: 56857 - DNA, 302 bp, Homo sapiens
tggactcgtttcctaccactgtccaggcaggagacaggtgtgccattagaaggcagtagtgttgtgacctcaccttgctttctttgtagggaagaagtggagaagcgctttgagggtcggctcaccaagaacatgtcaggatccctctatgagatggtcagccgggtcatgaaagcactggtaaaccgcaagatcacagtgccaggcaacttccaagggtgagagtgtgggcctgggatcctgccctgcctgggtatgggaaatgccgtgtctccttggtaaacccttcctgagatgggaat

SEQ ID NO: 56858 - DNA, 392 bp, Homo sapiens
acccatgcctgactccatcgttgtagttaccacattatttcataattatctgcttatgtgtctggcttctgcatgcttattcattgttctacccctctgtgcacagtgcctggcacagagtaactccctttgcagatactatcgctcggtaacaaatcaccccataatttagtggcttaaaagtgctatttaatcttgctcatggttttgtgggtgtagaatttgggaaggtctcagccaggcagttctcatttgggttctgccatggactggatcacccaaagtctcaagggggtgcatgcaaatgggcttgggttctgccatggctgcattggatgctggcaattggctgggagttggccaggctttccactgaggtgttacatgtggcc

SEQ ID NO: 56859 - DNA, 368 bp, Homo sapiens
gtttctgagttgagctctgatgggcagggatgaatgaatggtgggggcaggggagcatgtcatgttagcgtctctgggtggtggaagatatgagaatgaattggcagaagatccatctggaaggatggagagagggtcatcatagctcatagtagagagctggcggggagtgatggagtcggggctgggaggtcagaagtagccaggcaacgttggatgctgaagccttatgaaggaattttgccattaggttaaagatggcgagaagctgggggtacaaaattcatcaaataggaaaggatatagcacctttgtgctataccaacaaataggaaaggatatagcacactctgtcccccagccactct

SEQ ID NO: 56860 - DNA, 458 bp, Homo sapiens
tcattctccctctttcagtgtggtcctcccttagtgttcctatctcaggaaatgacaccctgttgtgttattcttgactcctttcataccccgcatctcatatacgtatcaggcaatgcctctaccttcaaaatatatccacatctgactactgttcttcacatccaccattattattaccttgggtttaactaccagtttttccttgggttattgtagcttcctaagtggtcctaagtgatcttcctgcttccattcttcttctgctccgtataacattgaacacttcatagtacacagaagctatatgtagaatgtatgatccttgtaaaacataaattatgttaatttgtctgtagagtcttctaacgacttccttttacacttacatacattgcagttttttcctgttgcttgcaatttcctaatagatccattctgtttatttctcttttctc

SEQ ID NO: 56861 - DNA, 815 bp, Homo sapiens
acatgaacaagattttctgaaagactgctatggagtctgagaaaaaatgtcaaagattgaggacatgaagaggaaagaactgacagaggaggtgaagaaaggtgatcaggaagagccatcaaagtgttatcctggaattcaagtgaagacagtgtttcaaagtggaaatgaacagtgtcctgtaaccctcagagtgagactagagtcagaatgcaggcttttctcatttgaaatctcaaggtaagtccaggtcctaacctccacctaaaagttctgccatcaaggaacatctgctcattatcttctgttcacacatcaaatgacttcaatgtgatccctggatgttctccaaagagctgaagggaaataaatattctttctttatcaccaaatacttcaactgcagagtgattgtgctaccaaggcctgaaacttcggaaaaacctgcataacacaaaatataaaatatgccacagagaggatccagagagcccatctccggtcagttatctgtatttgtatgtcaactacagcatcaaaaagcataggcgtggatactaaggaccccctctgtacaccaacgccagtccaaaggacagtgtgtcactgtgaactggaaattcatctctcttcttcattttttttctacctactttatgctttatctctaagttgaggctgtttatggcctcatcctcaattaccttgtccctcattactcccagttaatggagattaagctttgtatcatgacttcctaactaaaattgaaatcacaagacatcacataaataaagttacaaatggattagata

SEQ ID NO: 56862 - DNA, 586 bp, Homo sapiens
acatgaacaagattttctgaaagactgctatggagtctgagaaaaaatgtcaaagattgaggacatgaagaggaaagaactgacagaggaggtgaagaaaggtgatcaggaagagccatcaaagtgttatcctggaattcaagtgaagacagtgtttcaaagtggaaatgaacagtgtcctgtaaccctcagagtgagactagagtcagaatgcaggcttttctcatttgaaatctatatgccacagagaggatccagagagcccatctccggtcagttatctgtatttgtatgtcaactacagcatcaaaaagcataggcgtggatactaaggaccccctctgtacaccaacgccagtccaaaggacagtgtgtcactgtgaactggaaattcatctctcttcttcattttttttctacctactttatgctttatctctaagttgaggctgtttatggcctcatcctcaattaccttgtccctcattactcccagttaatggagattaagctttgtatcatgacttcctaactaaaattgaaatcacaagacatcacataaataaagttacaaatggattagata

SEQ ID NO: 56863 - DNA, 930 bp, Homo sapiens
ggtcgaccacgcgtcgccacgcgtcgccacgcgtccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcatccaccctgggcctctgctgtccttgatcacaaaagttgtttttgcttgtggtcctgtgctctatcggggtgggcagtggaggatacctggtagctgggagctgagtcccaggagttttgagacccccaggatgtagcatctgtcacatcctcttggcttccggcagccaggaagctcatttggatgaccgtggcagaggcagatccctcctgcagccctggccaccgtctctcctggtttgacttggccctggacggagggtgaatcctcagatcgcgtaccttgctgtggacattcttgccca

SEQ ID NO: 56864 - DNA, 1205 bp, Homo sapiens
gagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtaaaacctcagcccgtgcatatggtcctcttattacccagccctccctcctccatgcccttaggctaatctccgtcccaccggtggagagagtactggtgaaatagatacacgtgggtttacgtggtagagaatgtcgtcttggtgaaatcatagtattccctaggacatggttttaagattttcacagggatcagaatgtccctcctaggggctttaattcatgggccaaaagagatggactctgccgtaagaagctccgcttggagggccgcagaggctgtgggaaagcggagagctcagaccccggcctctagtgctgcatccgtggcggctgcccccttcacagttagaggcaggctgagtggggtttttcctctttaaaacattacatagcgaagtcccagcccccgtgtcactctcctggccttggcggtgagtgcacctcgttgcttggagctgtcactccctgcgggccttggtcttgctggctacgcgtgggctgtgctcctccagccgccccgctcagggccgtccgcgtggcgtctttccctctggcagtgagtgagaacagggctgtgagatctcctcccctcacttaatccgtccagtgagaagattcaaccccgctcacacattttcccagtaaaaatgccacctacttcaaagaattgtcctcagtaaa

SEQ ID NO: 56865 - DNA, 2954 bp, Homo sapiens
gagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56866 - DNA, 2766 bp, Homo sapiens
ttcaccggaaccgagcaacggtaactgtgccccttcaccggaaccgagcaatggcagacgtgtcccttcaccggaacccagcaacggtaactgtgtcctttcaccgaaactgagcaatggttaacgtgtttcctcactcagttcccaggcattgctgctgctgatctggggaacacactgtatgagcctgacataaacctctacagagctctgtctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56867 - DNA, 2871 bp, Homo sapiens
gagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56868 - DNA, 3259 bp, Homo sapiens
gagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcatccaccctgggcctctgctgtccttgatcacaaaagttgtttttgcttgtggtcctgtgctctatcggggtgggcagtggaggatacctggtagctgggagctgagtcccaggagttttgagacccccaggatgtagcatctgtcacatcctcttggcttccggcagccaggaagctcatttggatgaccgtggcagaggcagatccctcctgcagccctggccaccgtctctcctggtttgacttggccctggacggagggtgaatcctcagatcgcgtaccttgctgtggacattcttgccca

SEQ ID NO: 56869 - DNA, 2034 bp, Homo sapiens
cggtccgaaactgacatagaggaggaggcccccttctgttcttcgtagccggggaggatgacatgactgactccctgcgagattacaccaacctgcctgaggctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56870 - DNA, 997 bp, Homo sapiens
gtgtccatcccccttcgtgtgtccatcccccttcgtttctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56871 - DNA, 534 bp, Homo sapiens
ttacatgatacgactcgagttagtaccctcgatagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcatccaccctgggcctctgctgtccttgatcacaaaagttgtttttgcttgtggtcctgtgctctatcggggtgggcagtggaggatacctggtagctgggagctgagtcccaggagttttgagacccccaggatgtagcatctgtcacatcctcttggcttccggcagccaggaagctcatttggatgaccgtggcagaggcagatccctcctgcagccctggccaccgtctctcctggtttgacttggccctggacggagggtgaatcctcagatcgcgtaccttgctgtggacattcttgccca

SEQ ID NO: 56872 - DNA, 198 bp, Homo sapiens
tgggaggtggagaagcagcgtgacgcagcgggtcttgctgtcctgtctttcagtgtccgccctgccgaagcctcacccgggtcctggtggaatcctaccggaagatcaaggaggcaggccagaacttcgagatcatcttcgttagtgcagacaggtcagtcgtgccgtgaagtgctgggccccttttctgtaggtagc

SEQ ID NO: 56873 - DNA, 492 bp, Homo sapiens
tcactgggaagtcggaggtcggaggtcatggcttctcattctgtggctgagagaaacactagcaggcgcctcaggtcctggcttaggggaagctcagcctcccaggcgggtttgtgaggaattcaatgggaagactgtctacctgggagagcagagctgctcagtgaggcaggttcctcctggggagcccggtgcaggagagcactgtgagctttgctgctgggacgcatgtgcacacacacccatgcatgcggggagcaagacctgcatccaaggggaacttcatttccgttcaggggccgctcaggcgggcgtttctgcagctcaggccccctcggcgggtgccgctctgtttgacaagccagtgctttttctccccgtctttttctacccccgacccaatcacagattctgaggatgacggagagtccgaggcggccaagcagctgattcagccgatagctgagaaaatcattgccaagtacaaagcca

SEQ ID NO: 56874 - DNA, 1194 bp, Homo sapiens
ttcaccggaaccgagcaacggtaactgtgccccttcaccggaaccgagcaatggcagacgtgtcccttcaccggaacccagcaacgctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagc

SEQ ID NO: 56875 - DNA, 739 bp, Homo sapiens
ttcaccggaaccgagcaacggtaactgtgccccttcaccggaaccgagcaatggcagacgtgtcccttcaccggaacccagcaacggtaactgtgtcctttcaccgaaactgagcaatggttaacgtgtttcctcactcagttcccaggcattgctgctgctgatctggggaacacactgtatgagcctgacataaacctctacagagctctgtctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggttctgcggccatgagcgaatttgcaagacacgctgcaaagctgcctgtaatgggccttatgatc

SEQ ID NO: 56876 - DNA, 2638 bp, Homo sapiens
ttcaccggaaccgagcaacggtaactgtgccccttcaccggaaccgagcaatggcagacgtgtcccttcaccggaacccagcaacgctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56877 - DNA, 2682 bp, Homo sapiens
cattacggagtccgtgtatctgccgcggggactttcctaggagaggcgtcactgcaacaggcctaggaggggactggcttgggaaaaaaagaagaatattgtgtgtgatatgcaggaactgagaaatagcctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56878 - DNA, 3703 bp, Homo sapiens
gagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacgcccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcaaaaaaaaaaaaaaaaaaaaaaaaaaaaaaaaaaaaaaaaaaaaaaaaaaaaaaaaaaaaaaggggggggcgacaaaaaaatccccggggggcgcccaacaagcggcacccggttgttggaaacaagcgggccccccaaagagaaggcggcaacaattaaaacgccacagcacgcggccaccggtataacaccactgcctagctggagcacacaccaacaagaggcaacctggagagaagagccccacacacgaggggggcgaaccacacacatcttgtcaccacacacatacccaacagagaaaaatataggacacgcgagaaggaaattatcaacaatagaggctattacatacggtgtctataacgcaggacaataatactgggctgcctccgaagcaattgtcttctgtttttttttcttttataatagaacgcgcaaacgccacacagaacgggacaaagggacgaagcagacagaagaagacaggcagaacgaagccacgagaggcggccaacaggaagaagagaagcgggggaggagaagggagaacgagaccgagcagcggcagccagccccagcgaggacgaaggccacccgcggcaagaaggggagaagcgaggaggcagacagaaagacagagcagggaacacagcgaggcgagagccgagagcgaacagaacagcaggaagaggagaggacgaagagaagaagaagcggacgccgcgcgacccccacgacccgatcga

SEQ ID NO: 56879 - DNA, 2599 bp, Homo sapiens
gagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcgacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctca

SEQ ID NO: 56880 - DNA, 348 bp, Homo sapiens
catctttttacatcaaagtactaccaagtaaagaatttaaaaattacttgtctagtcatgatatatttttctgctgctgctgaaaaatccctgtcttattatttcatgttcctttatcattcatttgatgacactgacagcaacttgctgaacaagtttaagaatagctgatatttactgagcaacctggactttgtactcatgcaggatacagctctcagtattgcactgcatgtaggctgtatgtgctgttcctataatgagtagaggctcatagtccctcagcccagtcctgcctgatatggcagcatatgctgtgaggagattacaaaggaaatcaaaatcatg

SEQ ID NO: 56881 - DNA, 229 bp, Homo sapiens
cagatatgttgctttagtccacaatagtgatgaatgaaccttttctcttcacggagggcttgtgaacaaaagctgaacaagcttcatatcaaagatggcaaatgttttcagtatatcctgaagggatgtatcttcgctgttagtaatctgtggtaaatttcactgtaactatttgatgtaaattgctagcctctgcaagtaagtcacactgtaaataggctctattttt

SEQ ID NO: 56882 - DNA, 141 bp, Homo sapiens
  misc_feature (140)..(141): n is a, c, g, or t
cttgcacaggtgtgccctctcgcatgcccttcttcccttgtttaccttttaaactcttattcatctttcattcttcattctctgtaaaatcttctctgattcctcaaattagaattaaaggctctatctatgctctgtgnn

SEQ ID NO: 56883 - DNA, 5833 bp, Homo sapiens
gtctcaacatgactgactgggaagcggtggctcgggcagagcagctccgctggcgcaggcaggaggagcaggaggattattaaataacgcagctggactctgtgcaactgggagtggagaggagcccaacagccgagaaggggagggagggcagaggagggggaccaggaaggacacccccgtgccccgaagacataaatccctgagtgcccgggaggagccttaacaagcgcacggagccctcaaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaattaaatcaccgtattcctgtctttgggtaggataaagatggttagtgtttctcgtgcatagttcatattaaaattgtcatgtactttttcttacattttagttataaacagagttgtgttgttgggttttttttcttagtcataaacaaagacttgtgggttttttttttccaagagtgaaagtttgagcatgttaattgaactaggttgcattgccttgaagactttactatataggtgtataataaatgggaccatcatgatcgtttatatagtccataatttatttattttttatctctatcacttactgatatgcattaaggtttcagaagataatatcaaatagcaatctgttcactgttaatggtgttactataaaagtagacctgatgaaaaatagataaaggaattataaagaattttaaattatataattaatagaaggaggaaaaaagagaaatgttaacgtcttatatttggtggtatatttatttgaagaatgtggcttgcttgcatgtaacctagagatgtgtttgtctctattacatacattcaagctcatcttgtgatactagtaagggggaaatggctgtattttttttcctttaaacgtttagttcatactagttcacaaaggatttcagacagagtaattgctagccaaatagagaatgacagctctgatctttgaaaaattttgcttttagtttttgttattgatgttgaagtaccgtgacataacacaaggtgataaagttggttgaattttgtcagatgatgcataaatactgacatgctatattctttgagccactgtcatggcaatataaacattttttcaaaatttcaaggatgaaacatcctaagaaaattattctttttctttactttccttattttttaaaatgttcttttttatgtaaatccaattttggtttatatacatcaacccatatctataattttatgaactgaagaacagaaagtcagtattttagtagccagcatacaatattctgactatgcagaaatctagatttggaacaaaagtaaagtaaatgtgaacattggcaatttaatcttagaaataagcttctaacaggaatatttaaaacccatttgatggcaaatatttctctttgacaaataaggcccaaatatgttataatatgttatatacttatgtgcactttagatcaatatatgaattgatctatggataattccatcatgttcaattagtagcagagcagaatcaaagagtacaattaaatacataaataaataatttttaaaagactaataggaatcaaggctgcagttttcttatacacatcagagctgttaagtacatccacattagccatagtccatgcaaattgaaactgtcatacctactgcatgatctgtttcccttgcattttctaacagaatctgtcagcgtgcacaagcaagatgaacaaagggaaattgagatagcagttttagcatggcatctgacaacttgcttaaattaaagctgtgtgcaaaatgcatctcctattataaaaatgtatttgtgccctgtgctttggggaaaagccattagacactccacccctgagctttaactactgaactttgatacatttgcaaacttagattggaactgataaagtaaggagtcgagtggatatgttgtacttgtaattttggttttccaaaggaacacacatgtgcatcaaggcagacatttgccaaatgttttctttctttgcgtgtttgtaattctgccaaaagagaacaatatacactgcaaattgcttgacttaatgagattgccatctaaagttcccaccatactttggaagctataatgatcatgcagatatacactttgggctgggcaatatttaagaaatgataggaaaatagaaaaatcatgattattaattgtggaattcagcttgatttgtcctaaatgttggtgtctgttgctagagtattttaaatctgtacataaataagcatgataaaataatcaaggattttttcccaggatatggaagaactatgtatcacaaataatgtttttgatttggacttttggagttgatagttttgttttcctggaagatagacttttgaattatactttataaaaataatctatttatagaagatctgtcatttaatagacattttaagagatgttttaaacgctagtattttcttgaaaaatcttttttaaagctgaatcattcaaaagaaaacctggattaaacagttcgattttaaaaggaagggtattttttggaaatatcatcttaaagctgttttgtatcagtattttcaacattgttataatattatttgtaatactaagtgtaactcaggcctggagaaggtgtaagcccactatgctaatgtacatcagtaactgtaaaacaggggttctttgtaagttcctcttgtgtatatatagtaacttataacaatggcatgtgggcattctttcagtgaattgctttctttgtactaaaatctctagttttctaagacagttccatgtataaaaatgatttatgcctttctccaaggcggtacatatccaaagacatgacaccagggggaaaaagtgcttgtttttctgatggaagcagtggtcttttcttttctttcctctttcttttgtgcatgtgtatgtgtagctaagcctaaataaccctgtaaaatttctgctgcaaattgtctcttctgaatttagaatgtgttttaaaggaacacttaggaagagaaataccttgaagaaaagctgtttccacctgaaataaactgttcccatttttataattattgg

SEQ ID NO: 56884 - DNA, 748 bp, Homo sapiens
  misc_feature (658)..(658): n is a, c, g, or t
tgaatttcaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgctattattaaagatgaagagagttcttcaagaggaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatccctgggaatactacntgccctgaatggctatccgcgcccgtttcttctcgcccgttcggttcccgccccgcccgtcaataaaaccttcctcgctcctccgcgagg

SEQ ID NO: 56885 - DNA, 781 bp, Homo sapiens
agggattgagaaagtaattggttgggtcgggtgaggaaggcttcgggaacttcctgaattttaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagttttcttcatgaatccagcattaatgtttcacttgtaaaacaactcacatacttttgtgtgattcgatgggctaaatccgacattaagaatttcaagctgcaacataacaggtatacagcagacggcaccctgcagaatctccaaggaatacttgagtcgtcagcgcttctgatgggttttggaaaaagacagtgagcagagaatcacttaagcaaagtggaaaagccgtaattgtgttcctctgagacacatttttactgaaattatgttttgtttttgtttgaaaatcagaatcaaaggcatatttaactacagttaaaatagctgtttttaatgagtgattctatcaaatatgatgttacaactttagataacataatgcaatttcttaaaagtagtatgaatctaataatattcacatgtttacagatgagcaaaagtgtttcagaatctagtgactcgtttagctggaatgcacttattccttaactgtatcattttaaccttgataaaattgaaaacttgtggaaa

SEQ ID NO: 56886 - DNA, 418 bp, Homo sapiens
agctacaagttagagttggattatctacattacgaagagaggaaagtgattgtaaaactagactttatttcattcagcaaaggaaattcattggcagggtgagactagtcgaagtgcagacatgagtccagcaagcagtaccacgtcacttcctgttagtcctcttactgaagagccagtgcctttcaagaatattcagcattatatcaactgtacacacatatggtctgacacatgccactgcatcattatagaagagccaaaggataaccaattttgcatagaccacataccctagggaattctgaaaacctgactaacatcaattgaagattggggttcaggaggcctagatgatccaccatgacttattcaaaagttgaagatgaaaggaaagaataaagactctttccatcca

SEQ ID NO: 56887 - DNA, 2578 bp, Homo sapiens
tttccatcttatacacaataaatttgaggcatagagaggttaaatttgagcagtgtcactgtaactcacttttaaaaactgtgtgataattaaatggcagtccttagttttaacccagttatggctggctgtaagttccatcccgtcatgaccattatgtttcctcaacttttctattttcctacttcctttgctctgctctcagtcactgggagacgaaagtgctgctggttagcacagaagaaactgctgctgctgcggcttctactgttgtctgccatctctgttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgaactaccgcaggaacataccaggaaagccaagagaatccacagacctttgaaggaattggatcaccgccacaggctccccgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagtgagttgttcatttaatttttcaaggccttgtaaaatcaattagataactgataagaaaatgtgatttataataaatgtgttaatattagtataaagaaagaagaaatattttatggc

SEQ ID NO: 56888 - DNA, 3217 bp, Homo sapiens
tttccatcttatacacaataaatttgaggcatagagaggttaaatttgagcagtgtcactgtaactcacttttaaaaactgtgtgataattaaatggcagtccttagttttaacccagttatggctggctgtaagttccatcccgtcatgaccattatgtttcctcaacttttctattttcctacttcctttgctctgctctcagtcactgggagacgaaagtgctgctggttagcacagaagaaactgctgctgctgcggcttctactgttgtctgccatctctgttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgaactaccgcaggaacataccaggaaagccaagagaatccacagacctttgaaggaattggatcaccgccacaggctccccgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgctcccgaaaattttgtgttccatgagaggaggttttatttgcttggctgtgtttcttgaagattctactgatgtcttcagtgatatgcatgcccccattaaagggaaaagtccggcatttacagaaggcttttgcttcaagagtagataaatccacacagactgaactactatgctatgatgagcgttaacgtcatgaatcctgtggctcaccacttcatgtctgaaggttagtgagccaatgactcatccctcaaggctctggatttgtttacttatttagcaaggtatagcagaaaatgacagcatgcccttaacacaaagcttttcctctagtactcttgtccaggaagaggtaataaaatttactttaaaaaactactcagtaa

SEQ ID NO: 56889 - DNA, 4200 bp, Homo sapiens
tgaggacacagtgagaaggcagctatttgcaagccaggaagagagccatcaccaagaactgaatctgccagccccttcatcttggatttcccagcctccaaaactagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgctcccgaaaattttgtgttccatgagaggaggttttatttgcttggctgtgtttcttgaagattctactgatgtcttcagtgatatgcatgcccccattaaagattctaaagcaaactactacacgtaggccatcatgttccaagtttttgaaagttcatctttttcatcttgttgataaatttcatcaacttttatgtagggaaaagtccggcatttacagaaggcttttgcttcaagagtagataaatccacacagactgaactactatgctatgatgctaccgtgataagctgctattctgctcatcacaaggagttagagtcctaattatttaaataaacagaaggaagaaaggaaggaaattaattttgacaaaggacctgaataatccataaaccagatgcctttagtgaaaacgaagtaagatcagctctggatacctcctaactcttcccctccttctcctgatgagggagaagtggaggcccaaggaaaatgagcaagttttgtaacaacacgaatggggaaggatgggaaagagaacagaatcggtggagggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaattaaatcaccgtattcctgtctttgggtaggataaagatggttagtgtttctcgtgcatagttcatattaaaattgtcatgtactttttcttacattttagttataaacagagttgtgttgttgggttttttttcttagtcataaacaaagacttgtgggttttttttttccaagagtgaaagtttgagcatgttaattgaactaggttgcattgccttgaagactttactatataggtgtataataaatgggaccatcatgatcgtttatatagtccataatttatttattttttatctctatcacttactgatatgcattaaggtttcagaagataatatcaaatagcaatctgttcactgttaatggtgttactataaaagtagacctgatgaaaaatagataaaggaattataaagaattttaaattatataattaatagaaggaggaaaaaagagaaatgttaacgtcttatatttggtggtatatttatttgaagaatgtggcttgcttgcatgtaacctagagatgtgtttgtctctattacatacattcaagctcatcttgtgatactagtaagggggaaatggctgtattttttttcctttaaacgtttagttcatactagttcacaaaggatttcagacagagtaattgctagccaaatagagaatgacagctctgatctttgaaaaattttgcttttagtttttgttattgatgttgaagtaccgtgacataacacaaggtgataaagttggttgaattttgtcagatgatgcataaatactgacatgctatattctttgagccactgtcatggcaatataaacattttttcaaaatttcaaggatgaaacatcctaagaaaattattctttttctttactttccttattttttaaaatgttcttttttatgtaaatccaattttggtttatatacatcaacccatatctataattttatgaactgaagaacagaaagtcagtattttagtagccagcatacaatattctgactatgcagaaatctagatttggaacaaaagtaaagtaaatgtgaacattggcaatttaatcttagaaataagcttctaacaggaatatttaaaacccatttgatggcaaatatttctctttgacaaataaggcccaaatatgttataatatgttatatacttatgtgcactttagatcaatatatgaattgatctatggataattccatcatgttcaattagtagcagagcagaatcaaagagtacaattaaatacataaataaataatttttaaaagactaataggaatcaaggctgcagttttcttatacacatcagagctgttaagtacatccacattagccatagtccatgcaaattgaaactgtcatacctactgcatgatctgtttcccttgcattttctaacagaatctgtcagcgtgcacaagcaagatgaacaaagggaaattgagatagcagttttagcatggcatctgacaacttgcttaaattaaagctgtgtgcaaaatgcatctcctattataaaaatgtatttgtgccctgtgctttggggaaaagccattagacactccacccctgagctttaactactgaactttgatacatttgcaaacttagattggaactgataaagtaaggagtcgagtggatatgttgtacttgtaattttggttttccaaaggaacacacatgtgcatcaaggcagacatttgccaaatgttttctttctttgcgtgtttgtaattctgccaaaagagaacaatatacactgcaaattgcttgacttaatgagattgccatctaaagttcccaccatactttggaagctataatgatcatgcagatatacactttgggctgggcaatatttaagaaatgataggaaaatagaaaaatcatgattattaattgtggaattcagcttgatttgtcctaaatgttggtgtctgttgctagagtattttaaatctgtacataaataagcatgataaaataatcaaggattttttcccaggatatggaagaactatgtatcacaaataatgtttttgatttggacttttggagttgatagttttgttttcctggaagatagacttttgaattatactttataaaaataatctatttatagaagatctgtcatttaatagacattttaagagatgttttaaacgctagtattttcttgaaaaatcttttttaaagctgaatcattcaaaagaaaacctggattaaacagttcgattttaaaaggaagggtattttttggaaatatcatcttaaagctgttttgtatcagtattttcaacattgttataatattatttgtaatactaagtgtaactcaggcctggagaaggtgtaagcccactatgctaatgtacatcagtaactgtaaaacaggggttctttgtaagttcctcttgtgtatatatagtaacttataacaatggcatgtgggcattctttcagtgaattgctttctttgtactaaaatctctagttttctaagacagttccatgtataaaaatgatttatgcctttctccaaggcggtacatatccaaagacatgacaccagggggaaaaagtgcttgtttttctgatggaagcagtggtcttttcttttctttcctctttcttttgtgcatgtgtatgtgtagctaagcctaaataaccctgtaaaatttctgctgcaaattgtctcttctgaatttagaatgtgttttaaaggaacacttaggaagagaaataccttgaagaaaagctgtttccacctgaaataaactgttcccatttttataattattgg

SEQ ID NO: 56890 - DNA, 367 bp, Homo sapiens
ctccctcccacccaggagccaaacaaatcagaaatagttgtcagcagcctgtagctcccctcatctccatgaggctcaagtaaaaattaaacatttctccccaactcacagcccaaagacataggccacgatttgaaatctggtgacagagtccttatctgggtttccacccagaggctgagcctgtgttgtcacaggtggaggttcctgcaggagacacctgagcgccttccaaagtctctgcgggcaaagcctgcatccttcctggtacttgctgatgtccatacattttcttctctgcaacctttcagggcatcgttaagcttgccaagttcttccaaatggcctttagtggagggaaccctgg

SEQ ID NO: 56891 - DNA, 474 bp, Homo sapiens
gaacaattaagaagaaatgtcagctccagaataaaagcaaatatggcagaacagcctgtttaatagaaaaaatgagggagacagctaagaataggtctcctgcaatcccattcaacttcagtgtttgagaaggctgtgcacaggcactaagctgcacctactcaagggcaatcagaacagaatgcatggagtgtacttgagaggattatgcaagccatacaaaaaaatcatcaatagagagcaaaagcctcactggtccgtgaagttttaaccctacttctgaccacaaactgattgaacaataagccattctgatggaggagtgactaccaggaatataggcttaaaaataaaataaaagcagtaattattggctgccttgaaaaatttgtgcatgagcaaaacttcaatgtctcagaaattttcacaagggaatctataagcttttagttctgggttgaccatacagcaaaa

SEQ ID NO: 56892 - DNA, 345 bp, Homo sapiens
gagcttcctagaggctgaagcaaaaatagtttaaaaccccactgttggttatcttactcgtatcagtgggcttgagggacatactcttctctcaatggagtacaaaaaaggttttcttgttccaaaaaaatttttttcatgtgtatttatattcaagaaagatacagcattaaagaatgtggatcacagtgaaagtacaaatgaaacagtaaatgtggttgttaagagcacagactttgatgtcaagattgacccaaatttacaatctggctctacaactggttacaatgttaagcaaagttgctacacctcagtttccttttctgtcaattgggaggtaaaagt

SEQ ID NO: 56893 - DNA, 447 bp, Homo sapiens
ataaaaagcaagagaaacatacaaatcaggcccatctggagagaagggagtgaagcattgcgctgatacggggataaatatgctggttgggtagacaggcagtccttatgcttttggctgacgtagatgttacgtactatttcatgtgttatcacactctccagtaaacacgtaacataagagaataattaaccactatcaagcgttctcatcttgagacaggaagatgtagaggaaagaccttgatgtgtgtgtcagttacaaggatgtacaccagtgactgacatgacttggtgcaaatcttgggtagagacctatacttaagctcctcacccccacctgccgaggcgtaagggctcagagggggttccatggggtgggcgggagtggtaagggtcgaggtgcagccacagcctggctctgtgcacaccccctccctccccctgg

SEQ ID NO: 56894 - DNA, 218 bp, Homo sapiens
caaatcccacagctagtaagcaaatgcaccaattataaaccaggtctcctaagcctgatgttctttttaggttgactttcaataaggtctcaattgttgctaaatcaattccatctctcctttggtccaagttccaaatgatttttgaataatctcaagttgtttatagtgaaccaatttagtcctgctagttcaattcaaaataagaattcatattt

SEQ ID NO: 56895 - DNA, 411 bp, Homo sapiens
gcatttaaaaaatactgtgtcctcccatctagaaacatgattttttctactgattgcataaaatgttttccttttgttttcactcttccaataacaattctacattttgtttttatgtttctttcaccttttctgttatgtctatgctaggcatattataatatttgatgctaccatgaattttcccccaatgatgttgtacattttttgccagtttacagaaaagctattgattttcagtgtatattatgtaacctgccatgaaaccgcatttttttttgaaaatttgttcttaaagattttttctattgattatttggactttcctaagtatatgatataatcaggtataaataaatagtgagggttttacatttttcatactttcacctcttttagaaagttttggca

SEQ ID NO: 56896 - DNA, 2514 bp, Homo sapiens
  misc_feature (69)..(69): n is a, c, g, or t
acttcaaataatgaccttttttctacctaacaattactgagcattcaactctgtgctgcgtgtgtgctnacccttcacacacaccacctcactaatcctcacagtccttgaaggtggggactagtgtcacacgtggccattgggaacatcacacagatcaaaggctgggctcaaggtcacattgcctaaacacacattcatgtgacgtgagaaccttaactcttgccctcccagtgacacttccttctctgggtttccattccgccttgcagagagcattctgacttactgtagccttctgtgtgtgtgtctcccctctctactgtgagcccctcgagagcagggcccatgccttccccatccctgtcccagaagctaactggaaacagtggagacatgcagcagattgttgactgaagaaggtgctgcgtccatggtcatccctcatatcctttataaatttcttacacatttcattcctttgtgggaattgcatcttgaagctttgtttatagccatctgcgtgggtcccttaggctatgtggctgactttaatgctacagatatttttccgtttctggcatgtagcagtgctgggcttagcattgtagagattataaaagagaagacatggcccctgccctccaattgcagagatgagaccatatggaacacaattagccattaaagacaatacatttcagtatttgcatggagtatttgattatatagcacatgcaaattctttggaatgacatacaaggccctgcaagatctgattctaggccactttcccagtttcatctgctactctcccacggatccccccacatcccagacatactgaggtgtgtgcagtcctctgagcccaccatgcttccaatgtcaccatctctttgtaggtgctgtttcttcttcctagaatgcctgtcttgttcctatctgcctggcaacttcttactcatcttttagaacactgtctagtgccagttctttcctttttgtttttgtttttgttttcatggcctttgtatgtttttctgtagtgtgacccttatcacataagtcagttttgtaagtctgctctgcctgttcattgttgagttactttaggtcaagatccgtgtctcagtgatggaaaaatgaatgacaaaatagaaattggataaatgggaaggaaggagtgatgatctaacatggctgggggtcagtggggaatcactttcattggccagaatagagagctaaataaagtggcttaaaggcattagaggttcatttgcatgtggaaaaagcctggaggtggatggttgagtgctggtgtgggtgccacaatgtcatcaggagcccgggctctgctgcgcagcttggccacctttaatgcgaagtttccctcttcagggtaatctcgtggctcaaaatggttgctggagctgcagccatcttatccatttcaggcaagaaggactagagaggtcagctggtacaaaaaaaaaaaattatgttcattccctgaaggcagtctccttcaaacagatttctcagggtcctttacccaggagcttcatctgcatctcaggccaggatgtagtcacatgttcacctctgagtttggaagagatgtaaatatacagcaataaacataggttatctccacatttaatttaaaatgacattgctttttaaaacagtttttaggtctgaatacacatttctcaaaaaaagatataaaatggccaataagcatatgaaaagatgcttagggaattagtcattagggaaatacaaatcagaaccacaatgagacataatttcacatctaccaggatagcactagagtcaaaaaggcataataacaagtgctggcaaagagagaaattagaattctcaaaacgccactggtgggactgtgaaatgttacagcagtctggcaagccctcacaaagttaaacacttgagttaccctatgacccagcaatcccacttctaggtatacatatgtgagagaatgaaaacatacatccacacaaaagcttatgtatgcatattcatagcactattcataatagccaaaaaataaaaataaccaaaatgcccattaacaaatgagtggatcaacaaattgtggtatatccatacagtggaatattactctgtcattaaaaggagtgaagtactgatacatgctatataacatggatgaatttaaaaaacattacagcaagtgaaagaagacagtcacaaaaaaacccacatagttgatgatcctatttttatgaaatgtccagaacaggcaaatccacagagacagaaactagacgaatggttgcctgagggtgaggggaaacagggagtgactgatgatgggttttgtgtgggggcaatagaatgttctaaaatttgatagtaatggttatacaactctgaatatactaaaagccattgtacacacgttaaaaagggtggattgtatgtgaattctatctcaataaagctgttcaaaaattcagtttt

SEQ ID NO: 56897 - DNA, 331 bp, Homo sapiens
gactcctcttctgggctggaactgtggggcttgagagaaggaaattgggaccaggcaggcaggaggggctaatggtatcaggaggtcagggctgcgggaagaggcagcagtgttggtggtgtaggggtctctccccacggctttacctctgctcttgctgggatcctggtatttcactttccaactcctgtctacgtgtgctaggaaagtctatctcctccccagtcctaaccccaatttttcaccctcaggaaaaccacagaagaccctgagcctccggacaggtggacaacccaggaccggtcctgaaatccagggaagcaacgggggt

SEQ ID NO: 56898 - DNA, 200 bp, Homo sapiens
atgtctcggccggcgctgtctggcttgtccgcagcccctccccacgccccgcggccctcccctgctttcacactgccctccccaagctacccaccctcgccaaatggcctcctcttggccaaagagcagcccgctgcgcgcctcctgcaaacgcggtctactccagcgccctgaccccaaggcgggcgggagagggtagc

SEQ ID NO: 56899 - DNA, 500 bp, Homo sapiens
gaaggttcattaagtttccacatcaacctcagtctcctcactgtgagaaggcctggccacatagcagcagcccttcaccctccatgttcctctggctactcctttctggacctatttcgccttaacagcagctttcttggagcacagagcttggagatcaatggagtatttcaggtgtgagagcccagctaggcgtggaagagggtggcaaatggctaggccagggaactatgaaatatatttgccttaagtaaggagatggaaagataagccctccagagtagggcttatcaactgagatgacttcgaaaataaaccagaccctgacctaggactttagccgcactccgtcccccctagcgcagcagctgacatatcagctagtgttggcagtaacaggatttgcagacttcctgggaggcgtggcagactcagactatagggacctggggtgtgggtgttcaaccaaataattgagaagacagtcaccccaaaatgtg

SEQ ID NO: 56900 - DNA, 155 bp, Homo sapiens
ggaagaggggcaaatgagggtccctccctgccccctactgggtgacggcatggcacctttcatgggtctgcaggaccagtctcagctactgaaaaagtctagctcagtcctagccccacaggtttcccacaaacgccctggaaagagccatggag

SEQ ID NO: 56901 - DNA, 380 bp, Homo sapiens
gtctgtcctctgagttcccatagaatctgaattacaccactttattcacacttacattatgtgtttacttttctgagtgtcctattaatctttattccttaaaggaaagcctgagggcatcttgtttaacaatgcatctctctcttcatcaatcaacgctgcaggtgcttacaagacttataacttaaaaaaattataatacaaggctcagcgcagtgcctcaagtgccaacagtttcggaggccttggcaggcggatcacttgaggccaagagttcgagactagcctggccaacatggtgaaacaccgtctgtactaaaaatacaaaaattagctgggtgtggtggcacgcgcctgtagtctcagctacttgggaggct

SEQ ID NO: 56902 - DNA, 282 bp, Homo sapiens
gacaagacctagaagcaacaatgcccagtagaaacaaacacacctactgcctggatcttagtttttaattatattccccaataaagagacccagggctccttgttgaaatggctgattctaggactggggcaggaaatatgcaagatgaacctagaatatctaatactgccaaaaattaagaaagtgttctaaaaaaaatcccacaatgatagggtgtcaaaagagacatagaagccatctgaaggagttcccaatggccaaagatcaaataattttatcaa

SEQ ID NO: 56903 - DNA, 7122 bp, Homo sapiens
  misc_feature (3058)..(3058): n is a, c, g, or t
  misc_feature (3121)..(3121): n is a, c, g, or t
  misc_feature (3202)..(3202): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtgaagagcaacagtatggtgggtggacctgatccataccttaaagaatttggtattgttgtccacaatgaaatgacagagctcacaggcagggtacttccagcaccaatgctgcaatatggaggccggaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaagggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaagaaaaaaaaa

SEQ ID NO: 56904 - DNA, 6727 bp, Homo sapiens
  misc_feature (3058)..(3058): n is a, c, g, or t
  misc_feature (3121)..(3121): n is a, c, g, or t
  misc_feature (3202)..(3202): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtgaagagcaacagtatggtgggtggacctgatccataccttaaagaatttggtattgttgtccacaatgaaatgacagagctcacaggcagggtacttccagcaccaatgctgcaatatggaggccggaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaagggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgta

SEQ ID NO: 56905 - DNA, 5031 bp, Homo sapiens
  misc_feature (3434)..(3434): n is a, c, g, or t
  misc_feature (3497)..(3497): n is a, c, g, or t
  misc_feature (3578)..(3578): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatac

SEQ ID NO: 56906 - DNA, 7439 bp, Homo sapiens
  misc_feature (3375)..(3375): n is a, c, g, or t
  misc_feature (3438)..(3438): n is a, c, g, or t
  misc_feature (3519)..(3519): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaaggatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaagggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaagaaaaaaaaa

SEQ ID NO: 56907 - DNA, 5487 bp, Homo sapiens
  misc_feature (134)..(134): n is a, c, g, or t
  misc_feature (156)..(157): n is a, c, g, or t
  misc_feature (163)..(163): n is a, c, g, or t
  misc_feature (165)..(165): n is a, c, g, or t
  misc_feature (173)..(173): n is a, c, g, or t
  misc_feature (182)..(182): n is a, c, g, or t
  misc_feature (188)..(188): n is a, c, g, or t
  misc_feature (190)..(191): n is a, c, g, or t
  misc_feature (1423)..(1423): n is a, c, g, or t
  misc_feature (1486)..(1486): n is a, c, g, or t
  misc_feature (1567)..(1567): n is a, c, g, or t
tgatggtactatccactgtagtgcctgctggtacatgccacttttccctgccctttctgttttatctgcacagaagagtcgtgtgtgatgtcttttttgcaccacaatataagttattcctggccggtaatctnctcccaagctaatacatgcctnncgaatngntattagtnctggccagntacctntnncatttgtccccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaagggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaagaaaaaaaaa

SEQ ID NO: 56908 - DNA, 6524 bp, Homo sapiens
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaagggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaagaaaaaaaaa

SEQ ID NO: 56909 - DNA, 5227 bp, Homo sapiens
  misc_feature (3434)..(3434): n is a, c, g, or t
  misc_feature (3497)..(3497): n is a, c, g, or t
  misc_feature (3578)..(3578): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaactcaggtcttcccctggtcccccaggcacttccctcgtcccctcct

SEQ ID NO: 56910 - DNA, 5222 bp, Homo sapiens
  misc_feature (3434)..(3434): n is a, c, g, or t
  misc_feature (3497)..(3497): n is a, c, g, or t
  misc_feature (3578)..(3578): n is a, c, g, or t
  misc_feature (5212)..(5212): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaacacaaagctgtccaattgcaatctgtcaaantttttttctt

SEQ ID NO: 56911 - DNA, 4625 bp, Homo sapiens
  misc_feature (3434)..(3434): n is a, c, g, or t
  misc_feature (3497)..(3497): n is a, c, g, or t
  misc_feature (3578)..(3578): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaattttttttttttttttttttttttttttttttgtttttttttttttttttttttttttttttttttttttgtgtgtttttggggggggaaaaaa

SEQ ID NO: 56912 - DNA, 738 bp, Homo sapiens
gaatgagtatatatttttaagtagagttctaaactagtggtgaaatttagtgttaatttctaaaatatttttggcagatgatttcactatataaccaaattttaatttttctggaaatagaggatataagatatggtttggcaaaggtttaagatgtggaaccctttacacaaaccaatttctctttgtctcttggcaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtca

SEQ ID NO: 56913 - DNA, 399 bp, Homo sapiens
tgttcaaatttgatttcagctcccagagttgagagtgaaatgaaggacctttcacatgtttaatgtgacacatgcaaactcttatttcttcaggtacaccccagtgggccgttcctttttctcacccccggaaggttactaccaccctctgggagggggcagggaggtctggtttggttttcatcagtctgtgagacctgccatgtggaatatgatgctcaacattgatggtaggatggaactctctttatccaataactctttgggctggtttttgtttgtttgtttgttttggcccttcccttttccctgaagtgaagtatccttctctgtttgttagtatctgcaactgctttctaccgggctcagcctatcattgagttcatgtgtgaggtttta

SEQ ID NO: 56914 - DNA, 7434 bp, Homo sapiens
  misc_feature (3434)..(3434): n is a, c, g, or t
  misc_feature (3497)..(3497): n is a, c, g, or t
  misc_feature (3578)..(3578): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaagggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaagaaaaaaaaa

SEQ ID NO: 56915 - DNA, 4531 bp, Homo sapiens
  misc_feature (3434)..(3434): n is a, c, g, or t
  misc_feature (3497)..(3497): n is a, c, g, or t
  misc_feature (3578)..(3578): n is a, c, g, or t
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtcagtaaggcatggtcttcaagatgagctagctttgagatgacaaaaaacaaaagaatagaaaactcctcctgggacacagttactctctggtttttatatatgcaggctttcctgttctttaggtgaagagcaacagtatggtgggtggacctgatccataccttaaagaatttggtattgttgtccacaatgaaatgacagagctcacaggcagggtacttccagcaccaatgctgcaatatggaggccgggtaagctttttattttattcagcaagcttcttccacaaccagtcaaaaagagaataatccagggtttctctactctgccactgctgaatttacccatagttttgttcattattgccttttgtgttctggctcatacctaatagaattttgtttattcactagtcaatagtaaaatggccttagattgtaatgtcttttctcttttcttttgtttcttcttcttcttcttcttctttttttttttttcaaagaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcantggactgaatttttacctcaatgtgcaaaggctgatcagcctgaactttctaaaggactttanaagaagggtttctatggaatattttgctagctgtggtgttcaccgcatccctctagtcttagaagagaagattattccttntttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaa

SEQ ID NO: 56916 - DNA, 369 bp, Homo sapiens
acaatgaactttgcttttagtagacagccctatcgtattatgaagatatagtggagttttaatttaaagaaatttaagataggttttgattattgtgggagggaaagaaacattgagagagcacaaaaggaatagttagtcctaaaagagatcttcttaatccagcattaacattcaaatcaattactgagatgataatatcccttgaatcccataagcttttattatccctattgataatgcttaaaaatatgtaagttccaggaattccgtcctctctttcatactttattttcctctctttgtgttattaccagcatacagtcatgcaagaacaaattaacagttcattggcatacaaacatcttt

SEQ ID NO: 56917 - DNA, 651 bp, Homo sapiens
ccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctggtgcgcttggtaggtgtggtggcgttatggcagcccggctgctgcttggatgcgagcttggccttgggccggttgctgggggcacagctgtctgccaggcactctcatcaccccagaggccttgtcatcctccctttgccccaggcccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtggtgtgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaaa

SEQ ID NO: 56918 - DNA, 609 bp, Homo sapiens
ccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacactgctgcttggatgcgagcttggccttgggccggttgctgggggcacagctgtctgccaggcactctcatcaccccagaggccttgtcatcctccctttgccccaggcccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtggtgtgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaaa

SEQ ID NO: 56919 - DNA, 511 bp, Homo sapiens
ttctatttctttgtaaaatagctcactagtttctggatatttcaaaatttcatttagttatctatccacattttcttgtgattccctaaacttctttaagaggactattctgaattttgtcatatatttcatagatctttaaatttttctagctctattactaaaactttgtttgtttcttttggtgatgtcatagttctctgggttttcataatccttacatctttacattgatgcctgcatataggaggagacctcccccatttgcctgttccagcttttgctggtggtttttggtggtgttaggcttttactacttaacactggagcttaaccgccattctgcgattgcttcccggattgcggaagacttacagtgagcattggaatgtaaacactgcacaggaactgaattgttgtgctgcccttgtttcccagtctgagaaagacttaagttagtgccactacttaatcaccagcctttgggttgtttccaggtcaagggaaggct

SEQ ID NO: 56920 - DNA, 362 bp, Homo sapiens
gaagtatgtgtttagtgaatgcaccttttcttgttcctcagagcgagagaggctcacctatttccttccctcttccagagatgttgagataagccagtcaaggacagacattactcatgagaggatttgtcatgtgtgacaaagaaataaccccctagaaaatgtgtagacattgagttcttatactttcttttgtttggggttatcctgatgtttatttttgttagggaataggaatgtttattcatactttgaaacttcaatcattctgaggcaggagaattgcttgaacctgggaggtggaggttgcagtgagccaagattgcgccattgcactccagcctgggcaacaagagcaaaac

SEQ ID NO: 56921 - DNA, 365 bp, Homo sapiens
gccagctccaattatcaataattggaaccatacaagagtgtgttgtgtgtgtcactttttgaacagtaagtttcatttcgaaatctatctgaatcagcttgtaaaacctcaaaaccaaaacatttgttcatcatctctatgcaaggattgatcagaaatatatagtaaatgtatactctattttcctcaaaagtaatgagaaataattcatagtagtgttctagttaaatgatgtgaacagatttcatcatttaactttggttcatttaaactggatcaaaggcctaaaggatatatgaaaattttgaattttaaattatgaagacaattgtcctatggatattagaagaaaggaaacagaaggc

SEQ ID NO: 56922 - DNA, 271 bp, Homo sapiens
cttcatggggaaagagaagacaaacaaaaagctaagctgaagttccttattccatggccaaaagaagaagaagaaagtcagatatgttcagggtgctaagattcaatacggggaagaaccagctaaagggaaagagaaaggacagagcttggtagtctgacggcataggtcattaccatgcaaatactctactaaattgcccagattaaaatacgaattgtgagatactctcctccaatattcaccctgctcagttctggagcatgagagg

SEQ ID NO: 56923 - DNA, 998 bp, Homo sapiens
  misc_feature (809)..(809): n is a, c, g, or t
  misc_feature (812)..(812): n is a, c, g, or t
  misc_feature (824)..(824): n is a, c, g, or t
  misc_feature (827)..(827): n is a, c, g, or t
  misc_feature (829)..(829): n is a, c, g, or t
  misc_feature (836)..(836): n is a, c, g, or t
  misc_feature (853)..(853): n is a, c, g, or t
  misc_feature (857)..(857): n is a, c, g, or t
aaaattgaacaaacaagatgagtttggtgctttggaaagtgtgaaagctgctagtgaactcttttctctttatcaggagagtacctgaattaatgaagctcttgcagaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaaaaaaacaaaaaaaaaaaaaaaaanttngggggcgccggnccnangaaggtnctcaaacattcgtggcngcgngcccaaggaagaaactgccaaacgtcccggagcccggcggaacgggcgttcccccaaaagcgggcgccggcctttgaaccaaggctgcgtctggtaccaagcagccaccccccgccccgggacccaaaacaccccaccgca

SEQ ID NO: 56924 - DNA, 1456 bp, Homo sapiens
aaaattgaacaaacaagatgagtttggtgctttggaaagtgtgaaagctgctagtgaactcttttctctttatcaggagagtacctgaattaatgaagctcttgcagaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaaaaaaacaaaaaaaaaaaaaaaaaaaaaaaaaaaaaaaaaaaaaaaaaaaaaaaagaaaaaaaaaaaaaaaaaaaaaaaaaaaaaggaagaaaaaaaaaaaacgagcaagaggacaaaaaaaaaaagaaaacacaatcacaaggacaaaatacacaccaagatcagctaaaccaaaagccatgggcaaccgcgctgggccacacacctcgcgcagcaacggctgccatgacacccatgcactaccggaataagcagtccacatgcccgctccttaagaacaacaaacacaacgccacgggggacccacacacacgacacagtcaagacactaaggcactcggctcagacagtacacccaccctctctcgctggcggttctactatcaagccaacaccccaccacgacgaagaaaaggcggcgagccaacaaacaaacctgctaggcgcggagggcagcccccagctccgtcgcgaagacggtcctccgagtgcttgtaaactatcccggcggacgcgagcagaactgagcgagaaagtaggtaacgaagaccctgacgggagccgcgaaaagcagagacaacacacgaaggcggacaggctgagatcgatggagacaaacgaagaagacacaagccacacaagaccacccagacgacgccgcactaacaacg

SEQ ID NO: 56925 - DNA, 461 bp, Homo sapiens
cgtgtgtgcacgtctgtgtgtgtgcttcagtcacagaagggggtgagaagtgggaagaggggatttgcatagaacctccaattttccttatttcctagggagttgatgatttcagccaaatataagtcttaacgttacatctgcaatggaaaaacaagtcaaactcagcaaaaaggagccctgaagagacagagttaagtgcttccgtgatgagagtagagttggcctatgctgtccctcccaggactcctttacccaagagaaagagagagtgtgcatccaaaggggagtgaaaatagaatataaatagggaaaatagaaccattcagagcagttcagggatctttactactctgacatggaaggaagaaggaggagaagagaaaagatgaacggaccttgaacctgggatatcgctcatgtgactgctacattggtattaagatacagcattcatgtgc

SEQ ID NO: 56926 - DNA, 425 bp, Homo sapiens
cagctcttcttccagcagcagggaagacggggcagatgccagtgggctgcatgtttggtgtcaggagaatgagggattcccatctgacggcatctactttctctgacaagaaggaggcaagatcatttattgagagtcagaatgagagagatagagaaaaaaataaaactcactttaaagtgcaaatatcaatatacaattgatttaaagaatagagttttcagtctattcttccaaacctctaagaaagatattcttcttgcattgcagttgagagaactggggctgataattcaattaacttccttttccctaagatttcccagttggaaagagaaaaagctagcacttttttgtttggcattttgttttgttttgtttttgagacagggtctcacgcttacccagccggagagcaatggcat

SEQ ID NO: 56927 - DNA, 339 bp, Homo sapiens
cttattttgatttccaggcagagtggagatttctgtgctcaagtccacagcttggtttcttttcatctctctccctcccacccctacactgcacatggtgcagtcaaatgaagaatattcctcttctatctctggacccttgtccctcggtgttgagagcccaagctgttaatccttgaactcagataactgatttttaaaaagcaaaaaccagaacgaaagccataaacaataattatgtagaaacatacgtgtatgtgtgtgcacacatatgaagatgaaatatcggaaggaaaaaaaccttaaagttgcccaaactatttaaggcaccccaccctc

SEQ ID NO: 56928 - DNA, 379 bp, Homo sapiens
caggtgcgagccaccacgcccaacccagaactctttttattttgcaaaattgaaattctacccattaaatagcaactcttcttttcccttctcccccaagcccttggcaactgcttttccatttctatgacaatgtctactctagatacctcatagagggtgaatcatacagtatttgtccttttatgactggcttatttcacttagctgctatattattaataccagctttctggggatataattcacaaactgcagaattgaatggtttttagtctattcacatcggatatgtttttgaagagacagtaaaaccaatccttttttccttagttctcagacacacacatgcttcttatctggcaagtcccgttataaa

SEQ ID NO: 56929 - DNA, 1628 bp, Homo sapiens
cgtgtgagggcaaggcaggggggatttgctctgccacaggctactggaaagcagctttttgcctcacagatgtccacaaaatgccttattttacaagactcattttgttcttgttttgcttgatggttctcgtggagagcagaaaacccaagaggaagcgatggacagggcaggtggaaatgcccaagccaagtcacttatataagaagaaccttgatgtgaccaagatccggaagggaaagcctcagcagcttctcagagtggacgagcacgacttcagcatgagacccgccttcggaggccctgccatcccggtgggcgtggacgtacaggtggagagcctggacagcatctccgaggtggacatggacttcactatgaccctgtacctgcggcattactggaaggatgagaggctagctttctccagcgccagcaacaagagcatgaccttcgatggccggctggtgaagaagatctgggtccctgatgtcttctttgttcactccaaaagatcgttcactcatgacaccaccactgacaacatcatgctgagggtgttcccagatggacacgtgctgtacagcatgaggattacggtcactgccatgtgcaacatggacttcagccactttcccctggactcccagacctgttctttggagctggagagctatgcctatacagatgaagatctaatgctgcactggaagaatggggatgaatccctaaaaacagatgagaagatctccttgtctcagtttctgattcagaaatttcacacaacttccaggctggccttctacagcagcactggctggtacaaccgtctgtacattaacttcacgttgcgtcgccacatcttcttcttcttgctccaaacatatttccctgccactctgatggtcatgctgtcctgggtgtccttctggatcgaccgcagagctgtgcctgccagagtttcactgggtatcacgacggtgctgaccatgaccaccatcatcacgggcgtgaatgcctccatgccgcgcgtctcctacgtcaaggccgtggacatctacctctgggtcagctttgtgttcgtgttcctctcggtgctggagtatgcggctgtcaactacctgaccaccgtgcaggagcgcaaggaacggaagctgcgggagaagttcccgtgcatgtgtggaatgcttcactcaaaaaccatgatgctggatggaagctacagtgagtctgaggccaacagcctggctgggtaccccagaagccatatcctgacagaagaagaaaggcaagacaaaatagtggtccacctgggcctgagtggtgaagccaacgctgccagaaagaaggggcttctgaagggccagacgggttttcgtatcttccagaatacccatgccattgacaaatactctaggttgatattccctgcctcctacatatttttcaacttaatttattggtcagtgttttcctaggggctccaaggctgttcctagaagagggcatagacatcgaggggggctggccagtcattgacagacggacttgttgaccacacgcccctcaccaaacaatgcagcagctactggaccaccctgagcagcactcatctctcagagaagccc

SEQ ID NO: 56930 - DNA, 342 bp, Homo sapiens
aaagggctaataaatgtaaagatgaaagaaagcttctgattcacagatacccaattaataatagtttccaaattctgtgtagtatttctacagccttattttcccagactcactcctgttgctaggttactgttatgaccttaaagatcaatacatacaagcttttcttatataggtctttttatttcttcaccattattaccctcagtctggatgcttacttccttttttcgacttttgtgttctcttttattcctaatgcagcagtcagtcttcttctaggacagtttataccactgcaaagtaaaagcctattatcaagtttcccctaaatatttggaa

SEQ ID NO: 56931 - DNA, 436 bp, Homo sapiens
atcagggacccttttgatccaattatagttattgggcagatacagtagtaccctattatcagaagacctagtttcaaatcctgagtcaatttctaattcactgtgtgaccttgtacaagtcacttaagctctctgatcattggttcaacatctttaatatgaggagagtaatgcctatctcaattacctcataaaattattgcaaagatcaagtgagttgatatgttacaaattatttctaaattataagattctgtataagtggaagggttaagtatactcccatattattaaacaccctacgtatcactcaggattctatatgactctgagttctcaatttctagaaatggtcccatttttgctttgttccctacaattctacggagtcttttttttttttaaaaggaagggtgtaggcaaaggtaaatgggag

SEQ ID NO: 56932 - DNA, 459 bp, Homo sapiens
tggctagagtctggtctcgtggactttcaagggttctttgccccactcctgagtttacaccactcttggctaatctgtaagtcccagcaaacagagttggagaaactgctttctcttggtttgactttgaatgctttcaaagtagttagagatatatttcccaaacaaattgcctcttggcaaatagcatagtatcatgccatagttctcaaagttcactgagctccaactactttcttcaagtgaaagttgaagcatacatccaaaatacaaaacaaaaagggcagcaacacctgtagttaaagtgggagtaggttcccagagccccacttgctcagcctccctctgtgtgggtcccaggatccataagtagtcctcagaaaacactgctggccaggatgtgattaaatcccaccccaactctagaaccacccccagacccctctccgccccacccct

SEQ ID NO: 56933 - DNA, 409 bp, Homo sapiens
ctgtgggtagaggtccttgtgatcgaggctggaaggctctcactgtgcctcttttgagttcaaaggaaggtgatgctcaccgtttcccatgaaggtgggcacagcctccaatcagaagcggatctgaggccgggcgcagtggctcacgcctggaatcccagcactttgggaggccgagggaggtggatcacctgaggtcaggagttcgagaccagcctggccaacatgatgaaaccccgtctctactaaaaatacaaaaattagccaggcgtggtggtgtatgcctatagtcccagctatgcaggaggctgaggcgagaggattgcttgactccaggaggtggaggttgctgtgagccgagatcgcaccactggaccccagactgggcgacagagcaagactctatctc

SEQ ID NO: 56934 - DNA, 976 bp, Homo sapiens
  misc_feature (8)..(8): n is a, c, g, or t
gaaggagncaaatcagtactgtaagctggatgcctaatgatttcccatgggaactcttgcagaattgcccttgtctgatgagaggaatgagcgagaacattgtcatggtggaggaggactctctggtgaagctttcccaggcatttttctgctaaagctttgactttgtccaaacactcataataagcagatattatcatttgttggctttccagaaactcaacaagcaaaatgccttgagcatcccaaaaaactattgccatgacctttactcttgaccagtctgcttttcctttcactggaccacttggccactttgacctcttagtacccttttttttttttttttgagacaatatctggctctcttgcccaggctagagtgcaatgatgcggtcttgtctcactgcaggctcaacctccctggtagctgggactacaggcacgcgccactgtgcccagctaaattgctttgattgtgctttgtcttcgggattgtactggtaaagccatgtttcagttcctattgcagttcttcgaataagtgcttcaggatcttgatcgtacttgtctagactttctatccaaagctctgctcttgtctacagctgatctgggtgcaaagggttttaacagccattgagtggaaagcttgctcaactttaatttttcagtcagaattttgtaagctgaaccagttgaaatgaccacagtgttggctattgtttctgctcttgtcagtcctcttgaatcggcagaaacaagatgaatttttttccccgtaaattgatgtggagggcatgatgttcaacatcatctcaacccttcctgaaacaatttatccagctggtcatcatggttcatgcctataatcctaccactttgggaggctgaggctggcagatgactggagcctaggagtttaagaccagcctgggcgatatggcaaaaccccatatctacaaaaaaaatagaa

SEQ ID NO: 56935 - DNA, 368 bp, Homo sapiens
  misc_feature (36)..(36): n is a, c, g, or t
  misc_feature (73)..(73): n is a, c, g, or t
  misc_feature (96)..(97): n is a, c, g, or t
ttgtgtgtctgtagaaggtccgtggtgacgtgtgtntctgcaatgggcctatttcccaataagatcatattcntaggtactaagggttaggacttnnccatatgaattttggggaacacaaacagtaattgtgaagtgttatgttagcataggaaggttaggggaactcagactggtatttgaaacagttaccctagcctaaggttaggaatattatttggaaaccattgttttcttttgctaaagtgggtgggataaaatcaggaagtacaaagctgaagaccacttaagtccatggaggaaagccagattattcggtgaaaagtgttaggacatcggctggtcttccagcaaacaatgcaagctgg

SEQ ID NO: 56936 - DNA, 398 bp, Homo sapiens
tttttttttttgagacagtctcgctctgtcgccaaggctggagtacagtggcgcgatctcagctcactgcaagctccgcctcccgaattcaagcaattcttcagcctcagtctctccagtagctgggattacaggcacctgctatcagcccagctaattgtttgtatttttagtagagacagggtttcaccatgttggcgaggctggtctcaaattcctgacctcaggtgatccgcccacctctgcctcccaaaatgctgggattacaggcgtgagccattgtgcccggcctgtctcagaacattgacacccctgacatgagagctaattggccccagtcaggagcttcaaaagacagcattggccagttgtggtgtgcatgcctgtaatcctagtgc

SEQ ID NO: 56937 - DNA, 186 bp, Homo sapiens
ccagtctgtgtggctcccggcttttcctcccactccaagctggcttccaagccccactcctcagcagagtgtctgaggccctcacatctagctctcttccctgctcccaatctagccagattcacgcattcccatccagcctctggaagcacacaccccatcttcacttatgtgctttccccacgg

SEQ ID NO: 56938 - DNA, 365 bp, Homo sapiens
aaccaaaaaatctgtgactccttctattgtaatatttgctttattgcggtagtctggaaccaaacacgaaatatctccaagatatttctgtattttgaagaggagtgagttactttttatttatcatctaaattctagagggcatagcttgtagaaattgccaagttaggtatttttgtagtcctaatacacttcaatttgtgctgtccctttttttccttcaaaaagctcaaaacaagcaattaatagtggaaaaataaaacaaatcttgttctccatttctttaaagcagttcacttgttaagcctttttatacctaggaagcctcctttgagaaggctttaaaaggagtgggggtagattct

SEQ ID NO: 56939 - DNA, 569 bp, Homo sapiens
ccctgaggctggagtcaggctctgttgccactttgaatccaggggcccaccctgaaccctgagctgggcttctgttcagtacgcggaggtgatgacctctcccacccggggggggtttgaggactcccgaggtggcaggggtgacgcccagcccagcatgcagagtgcccaggcagtgcccacacctttcctctccctgccaaggtgctccgggcctgagcctgtgtggccccctgcttggggctgtcaccacaatgccattccccgcacgcccagcaagtccctcctatgggtgagagcctaacttgagagactcttttggggaggagtaagatgacctgcccttctcaagagtgagcagttcttagatgactgccttgagcagcgatggttcttcctgcaggggtgcgcccacgaaacgctctgcgtgaagcacattggtgccatgctcaggcccagggagagtggagggtgctgtgctcttggactgggtcctggctcgagggttgaggggctgggccatgtccacaaaaagtcactggatggctgggctgctcccactgtgtcgc

SEQ ID NO: 56940 - DNA, 386 bp, Homo sapiens
agtcattgtgtatattatgaaagttggtctcaatttagtcaaacctgggtttcaggggatatagctcacataaaaaggaatgggaggtatcattatatggaaatacctgctgtgtgccagagcatcctttaaggtattttgttttctgtgatattttcaaaccctccactttacagatgaggaaagtcaggcccagagaggtcaagaaaatcacttcaggccaaacaaggtcacatggaaaagtagggattcctgtgaactcaccctgtgttcttcctactccttcatgctgcagaaactctccctgaatccaaatgatgccgctgctgaagtgtgggctggttagagtgcatcacacagagccaagcctcattgtacgggaaggt

SEQ ID NO: 56941 - DNA, 688 bp, Homo sapiens
atctgcattattgcaggaaagatctaactcctaggtgaggcctggaagcacagtctctggtgggttctataaaacccactcttcatttatttattgacttcttgggaccgggtctcattctgtcccctgggctggagtatggtggtgccatcacagcttagtgtagcctcaacattttgattcttaagttgttgcagctctgtccgtggggagccccttcaggtggctcctgtgtcatgtgtttgaagcacatcctggcttgtgacactgcaagttggtgccgcaggctcatcgtgtaggccctgtctccgttctgagtccgctgtttctccaaggagtcttggtgccttttactagattatggtgttgagaccaagacctgggctctaggtgtgctcactcctgctgggatgttgctgctgcttctgggctctctccgtggacagagtgaggaagggtgtgcctgggagctagtctgtgtgtacactcatagctgtatttatgttcatttgtatttatagacatatatgttaaataggaatacatactgatacctcagagcctaatccagcaccacagagttcattctgccctcccccccaggtttatttgcagtttccttctcggatagtgagaagcctggctctcacttctgccatttatttactttaaaaaaaaaaattagaag

SEQ ID NO: 56942 - DNA, 518 bp, Homo sapiens
gctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcaca

SEQ ID NO: 56943 - DNA, 3171 bp, Homo sapiens
cagccaatgagcgccggcgggccggttgcccaggcgaccagcgcgcggctccgccccccgcggggaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagtttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcaccggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcaca

SEQ ID NO: 56944 - DNA, 1619 bp, Homo sapiens
cagccaatgagcgccggcgggccggttgcccaggcgaccagcgcgcggctccgccccccgcggggaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccaggtccctggttgagcagcggaatcaaccaggtcatcgtttttgaggagacgatggcgggccctgcattacagtttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcaccggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcaca

SEQ ID NO: 56945 - DNA, 1918 bp, Homo sapiens
cagccaatgagcgccggcgggccggttgcccaggcgaccagcgcgcggctccgccccccgcggggaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccacccctttgtgtccaagtccgcatttgagccttgttctggggcccagcccaacacctggcttgggctcactgtcctgagttgcagtaaagctataaccttgaatcaca

SEQ ID NO: 56946 - DNA, 1624 bp, Homo sapiens
cagccaatgagcgccggcgggccggttgcccaggcgaccagcgcgcggctccgccccccgcggggaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggtacccagcagacagcagactcaagttccaactcaggccctcgcttctgctctcagacccctaaagagttacttccttactgtcccacctcgaccccagttgatctgcgtgcaagaatatcctagacaaggacagggaggtgtgtgaggctgtttccatcttgccggcttcacctgttacaggtgttaacgctccttatctcctgtggaggacgggagaacgccctggctttcccccaggcctggccttcctccctggcctcagcaggtgctgagagctagcctgttgttcctcttggtgctgggacgcaggagcacatcgggtctgtggatgggagccgggtggggaggacgagcaggcagtgacatttgggtccgttgggg

SEQ ID NO: 56947 - DNA, 484 bp, Homo sapiens
gtaactgcacttgtgttgggccgtgggggctggcggcggccctgggctggctgtgcacgctcccgctgtgggactgcgacccaagtaggagtttctctggtgcctgttattctcccgtgcatatggcactgggctgcagacacccttgggttccatgagtggggagggtctgtgtgagagattgtggtgcgtggctggctgggtggctgttctcctgccctgctgggcactcgggctccaagggcactctgcagatgactgcttcacgtgcgggcttcctgttttcagaacatcgcagctccgttcttcccagctgcatgggccccgaacctggtagtgactgtgagctcctctccattccgcctggcacctaagccattgtttgctttatctcccagtgctcctggaatccctacaggcctaagcagttgcctgctagcagcacccctggcctgcattgctgcagtagcattttcactgttga

SEQ ID NO: 56948 - DNA, 3101 bp, Homo sapiens
cagccaatgagcgccggcgggccggttgcccaggcgaccagcgcgcggctccgccccccgcggggaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagtttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcaccggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcaca

SEQ ID NO: 56949 - DNA, 2961 bp, Homo sapiens
cagccaatgagcgccggcgggccggttgcccaggcgaccagcgcgcggctccgccccccgcggggaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagtttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcaccggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcaca

SEQ ID NO: 56950 - DNA, 2273 bp, Homo sapiens
cagccaatgagcgccggcgggccggttgcccaggcgaccagcgcgcggctccgccccccgcggggaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagtttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtaagcagccctccttcgaagtgtgtccaagtccgcatttgagccttgttctggggcccagcccaacacctggcttgggctcactgtcctgagttgcagtaaagctataaccttgaatcaca

SEQ ID NO: 56951 - DNA, 539 bp, Homo sapiens
ctgaatggctcaaaagtgtcttgcctccccaatggctgagatgaagacctgtggcccttccaagcttctccctgttcttcgtgctacatgtgctgtgctggggacaggaatgaccatgacagggcccggtgtcttgcagactatgatgctgtgctgacagaagccggcgattacacggccaagtacatgaagcttcgagacttcttcggctccatctcaggtacccagcagacagcagactcaagttccaactcaggccctcgcttctgctctcagacccctaaagagttacttccttactgtcccacctcgaccccagttgatctgcgtgcaagaatatcctagacaaggacagggaggtgtgtgaggctgtttccatcttgccggcttcacctgttacaggtgttaacgctccttatctcctgtggaggacgggagaacgccctggctttcccccaggcctggccttcctccctggcctcagcaggtgctgagagctagcctgttgttcctcttggtgctgggacgcaggagcacat

SEQ ID NO: 56952 - DNA, 478 bp, Homo sapiens
actttcaatttccatttcattataaggtatacaaatggtcagccagatgaagaggtacatgggaggaggactggaagggtcatgagcacaggagcctctgcttccacagagtcagggtgtgccgccctcttagtatcaggaagctcccctgagcatggtgtccagggtttttaatgaggtttcattatgtaggcatgattgattaaataattggccatatgactgaacttaatctccagttcttctctcctcctaggaagttaggggaatggggtgggtttgaaatttccaatctctaatcacatgtttgggctttttgatgtgacagccccttccttggaactatgtaaggatcccttagatagttccataataagccttcctaatagagtccactaggaaacaataaataaataagtttaatggctgaaacttcattttcccacttcacaaatattaggatggctactatttgaaa

SEQ ID NO: 56953 - DNA, 609 bp, Homo sapiens
  misc_feature (509)..(509): n is a, c, g, or t
  misc_feature (585)..(585): n is a, c, g, or t
  misc_feature (601)..(601): n is a, c, g, or t
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggttggtcggncttttttattttgtgggataatttaatttaagggggcgaaaggttttttcctttagtgaggggttaatttttaggntttggaattggccttnggttttaa

SEQ ID NO: 56954 - DNA, 1635 bp, Homo sapiens
  misc_feature (701)..(701): n is a, c, g, or t
  misc_feature (719)..(719): n is a, c, g, or t
  misc_feature (728)..(728): n is a, c, g, or t
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggttgtcctgcctttcccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggagg

SEQ ID NO: 56955 - DNA, 1569 bp, Homo sapiens
  misc_feature (635)..(635): n is a, c, g, or t
  misc_feature (653)..(653): n is a, c, g, or t
  misc_feature (662)..(662): n is a, c, g, or t
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggttgtcctgcctttcccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggagg

SEQ ID NO: 56956 - DNA, 1252 bp, Homo sapiens
  misc_feature (3)..(3): n is a, c, g, or t
  misc_feature (9)..(9): n is a, c, g, or t
  misc_feature (318)..(318): n is a, c, g, or t
  misc_feature (336)..(336): n is a, c, g, or t
  misc_feature (345)..(345): n is a, c, g, or t
ggnggaggntttgggggaccaggctgaaggggctctgactgcccttttgggaggagtgtgagtggcttccctttgctgcaaggagcattgtactcagcaattgcaaactcatccgtctcgtagtaatcatagactttcgccctttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggttgtcctgcctttcccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggagg

SEQ ID NO: 56957 - DNA, 1384 bp, Homo sapiens
  misc_feature (701)..(701): n is a, c, g, or t
  misc_feature (719)..(719): n is a, c, g, or t
  misc_feature (728)..(728): n is a, c, g, or t
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggagg

SEQ ID NO: 56958 - DNA, 1436 bp, Homo sapiens
  misc_feature (502)..(502): n is a, c, g, or t
  misc_feature (520)..(520): n is a, c, g, or t
  misc_feature (529)..(529): n is a, c, g, or t
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggttgtcctgcctttcccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggagg

SEQ ID NO: 56959 - DNA, 1325 bp, Homo sapiens
  misc_feature (391)..(391): n is a, c, g, or t
  misc_feature (409)..(409): n is a, c, g, or t
  misc_feature (418)..(418): n is a, c, g, or t
cagtctccagtacaaattaacaaaccggctgctggcttatgtatcagttgcctatgcatagggtcagtatactcacccccaggcctgaacaactctgggtcctcaggaaccctgaaggtgtgactggcaaagctgaggccctggctcgggagctgcttccctgagaggactgcgcctacagcatccttgacatcttttcataaaccagcacaacttttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggttgtcctgcctttcccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggagg

SEQ ID NO: 56960 - DNA, 326 bp, Homo sapiens
gaagattttctagaagcaaatagtgccaccatccgtcatgaggatctgtttctataacgcttgtgtgtctttgagactacgtaggtggtagcttatgagtagtaatgttcttttgttagtaaatgtcaccaaataagcaaataagagaaacatgaaggccaaaaactgtgttactattcaggagaaaatggacggtttagcaacaatacaatgtagacttcaaaatatgaaaaatcaaggaaatttctgtcattgtctttaagggcctccagagaagtattaatttgttctttatgtgaatttaatgagatcatgtgaaatgtatg

SEQ ID NO: 56961 - DNA, 315 bp, Homo sapiens
  misc_feature (197)..(197): n is a, c, g, or t
  misc_feature (266)..(266): n is a, c, g, or t
  misc_feature (270)..(270): n is a, c, g, or t
actccagcctggggaacaaacaagcaagactccatctctaaataaaaaagagtgtccccctaagatgctctgcgaaatattgtagactggtgtctctcttggatgatgtttgccgtcagcattcaccaaataaacttgctctctgggaaaaaaaaaaaaataataaataaaataaacagtaagaaacacccataaancaaatttctatgctcctgcagcctctttttgcctgagcaagtgggaccttggtatacacatcacctgtncttncccttttctttgaaatgtggtgtttgctgttaaattgggattgaa

SEQ ID NO: 56962 - DNA, 178 bp, Homo sapiens
attggagaaaagctgtgcttagatagggtgcatttgctcttgccttggaaggttgttttctgataaggttctatatcctctgcaaatcaaatcaggcacttacagtgtgagtatgcattctcttcctgccagtctggagatgatcaaaaagcctataacaggcttggcctattttcct

SEQ ID NO: 56963 - DNA, 3804 bp, Homo sapiens
aaataataatgcttttttcttttttgtcaacaacttctctcttttctacaaatccaatctttttactattacacatacttaattgcagttggtttttttccagttgctacagttcatttgaattctcaaatatttatctaccacaaggcagccatatatgctttgaagaccaggccatgactagaatttacattctttatacctaggtaattgaggttgcctaggaatcaaaagtcaaaaaaagtcaagagctcatctctggacctaaagccacattgacaattattcctctgtcttaaagaaactctctgcataagaaaaaaaaaagtcttatttttataccaaattcaaggtaaagctgacctgctctaaaatcatttttccaagtattgttctaatgtcttttggaaaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgcaacggaagagtcctgggcggaaggaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattattaaaaagaaaaaaaaaagccaaaaagaaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttataactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatcctacagagttgtgtttagtgtcgtttgccatggtatttcacagtgaaacatggatactctccacacatcatttacttcatgctgtgtacttatgtactggtttttgcattttactcacttgataagtctgctccactggtttcatcagatagacttgctgctactggcttttccattgtagattgggttattttacacgcagttcgccaaatgggattgctctgtatagtcaaattggtgatggacagatggacagaatgcagaggtacatagatgagctgaggctgatccagctcccctgaaattcagagtgttaactttgtagaccctgcacaatctcttggtgctatctagccattacccccattttttttttaaaggccatctgaaattccatttgtcatggtgggaagcattttggatatgatgcaggaaatctcttcctggagtcaaaagttcccaagaggtcctgtatttttaagaaatggaatttatttaaataatatttaagcttgtgcccatgttggccgggcaacttttttcaatggtgcttattagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgtttaaaaaaact

SEQ ID NO: 56964 - DNA, 2958 bp, Homo sapiens
attaattgatttcgatacgactttattctttttctaatcttttttttttttcacaaatggataccaattacatttaccattggactgcaatgtctctcctctccttgaaaaacaatgcggttgactgaaatcactttgggtggaccaaatttcctcctgttgactactcctgaatgatctcttccaattccccaaatctgcctctctggccaatcacaaccttcttccatgtgtgtacatcatgctgctctcgtcttcaactccccttctctcttgctgacttctggaaaagcaacggaagagtcctgggcggaaggaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattattaaaaagaaaaaaaaaagccaaaaagaaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttataactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatcctacagagttgtgtttagtgtcgtttgccatggtatttcacagtgaaacatggatactctccacacatcatttacttcatgctgtgtacttatgtactggtttttgcattttactcacttgataagtctgctccactggtttcatcagatagacttgctgctactggcttttccattgtagattgggttattttacacgcagttcgccaaatgggattgctctgtatagtcaaattggtgatggacagatggacagaatgcagaggtacatagatgagctgaggctgatccagctcccctgaaattcagagtgttaactttgtagaccctgcacaatctcttggtgctatctagccattacccccattttttttttaaaggccatctgaaattccatttgtcatggtgggaagcattttggatatgatgcaggaaatctcttcctggagtcaaaagttcccaagaggtcctgtatttttaagaaatggaatttatttaaataatatttaagcttgtgcccatgttggccgggcaacttttttcaatggtgcttattagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgtttaaaaaaact

SEQ ID NO: 56965 - DNA, 2806 bp, Homo sapiens
gcgggtgcctgtagtcccagctactcgggaggctgaggcaggagaatcacttgaacccgggaggcggaggttgcagtgagccgagatcacaccactgcactccagcctggcgacagagcgagactccgtctcaaggaaaaaaaaaaaaacaaaaaagaaaaatcgaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattattaaaaagaaaaaaaaaagccaaaaagaaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttataactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatcctacagagttgtgtttagtgtcgtttgccatggtatttcacagtgaaacatggatactctccacacatcatttacttcatgctgtgtacttatgtactggtttttgcattttactcacttgataagtctgctccactggtttcatcagatagacttgctgctactggcttttccattgtagattgggttattttacacgcagttcgccaaatgggattgctctgtatagtcaaattggtgatggacagatggacagaatgcagaggtacatagatgagctgaggctgatccagctcccctgaaattcagagtgttaactttgtagaccctgcacaatctcttggtgctatctagccattacccccattttttttttaaaggccatctgaaattccatttgtcatggtgggaagcattttggatatgatgcaggaaatctcttcctggagtcaaaagttcccaagaggtcctgtatttttaagaaatggaatttatttaaataatatttaagcttgtgcccatgttggccgggcaacttttttcaatggtgcttattagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgtttaaaaaaact

SEQ ID NO: 56966 - DNA, 4262 bp, Homo sapiens
gccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgtttaaaaaaact

SEQ ID NO: 56967 - DNA, 564 bp, Homo sapiens
aaataataatgcttttttcttttttgtcaacaacttctctcttttctacaaatccaatctttttactattacacatacttaattgcagttggtttttttccagttgctacagttcatttgaattctcaaatatttatctaccacaaggcagccatatatgctttgaagaccaggccatgactagaatttacattctttatacctaggtaattgaggttgcctaggaatcaaaagtcaaaaaaagtcaagagctcatctctggacctaaagccacattgacaattattcctctgtcttaaagaaactctctgcataagaaaaaaaaaagtcttatttttataccaaattcaaggtaaagctgacctgctctaaaatcatttttccaagtattgttctaatgtcttttggaaaggtccctgcgaccctgagtgcagtgaggttggctgtgacgggccaggaccagaccactgcaatgactgtttgcactactactacaagctgaaaaacaataccaggtaagagaggtgccaagtcacatccccacagcatgtgccaggcatctta

SEQ ID NO: 56968 - DNA, 602 bp, Homo sapiens
taagatgttgcgcaaagtaggagtgtgcccatcagtctaacaaattaaggaggctgtccccgaagcctagcagcgtgtgtgtatgctacagatatcattgtaggcacagagaagcattataagcattgagaggagaaaaaaaagggtacacgggctatttccccggctttgaagctttgccaaatccactggcctctgagggaaactgtatctgttacatatggagtttggggagtcattacgttttggcctcatcacaacagtctgtttgaagctccctttatacttcttccagcctgcagggatcccggtgctctgtctcctgtgaagatggacggtatttcaacggccaggactgccagccctgccaccgcttctgcgccacttgtgctggtaccttccctagttcttttgtttattctcccggttctggttttgcttttctttctggtttgggccatcactcatgcaacccacttgatacttttaaagtaatgctggaaaagtttatttctcgtttgataattgtgtgtgtattctcattgaaagtcaagcagtcatcagcatcctatcctcattgagaaacttacatagcccagtga

SEQ ID NO: 56969 - DNA, 5771 bp, Homo sapiens
gccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgcaacggaagagtcctgggcggaaggaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattattaaaaagaaaaaaaaaagccaaaaagaaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttataactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatcctacagagttgtgtttagtgtcgtttgccatggtatttcacagtgaaacatggatactctccacacatcatttacttcatgctgtgtacttatgtactggtttttgcattttactcacttgataagtctgctccactggtttcatcagatagacttgctgctactggcttttccattgtagattgggttattttacacgcagttcgccaaatgggattgctctgtatagtcaaattggtgatggacagatggacagaatgcagaggtacatagatgagctgaggctgatccagctcccctgaaattcagagtgttaactttgtagaccctgcacaatctcttggtgctatctagccattacccccattttttttttaaaggccatctgaaattccatttgtcatggtgggaagcattttggatatgatgcaggaaatctcttcctggagtcaaaagttcccaagaggtcctgtatttttaagaaatggaatttatttaaataatatttaagcttgtgcccatgttggccgggcaacttttttcaatggtgcttattagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgtttaaaaaaact

SEQ ID NO: 56970 - DNA, 946 bp, Homo sapiens
tgcggccgccacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgctctactaaaaaaaaaaagggggggtaaaaatcctcgaggggcagttaccgaccggttctgtcaagggcctaggagcgataaaaggcgccgcgttacggacggacgcgggctgaagcccctggggaggacccgaaccgaaatttggcaacgtgcggggtacag

SEQ ID NO: 56971 - DNA, 1605 bp, Homo sapiens
cctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctg

SEQ ID NO: 56972 - DNA, 1068 bp, Homo sapiens
gccggtcctctcacgctcagccacgggcggcgtgcgtggctctgcagtcgtccttccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaaggcaaggcctggtgaggggggccctggcctcatacccacctggattgtcttcctccaagtgagagaccacagcttcctgggcaggtcctgctctgtggcccagcagccccccttcaccccaacttctggccagattccaggccagcactcttgtcctcctgggaggcgtctacagggccagcccctggcactgccccaggagtgccttggctctgggtaggcccatccttcagctggctgcagactgttctgagcggtatttacatgtgcccactctcaggttgtcctgtggccatcagcttctctcccagacagaggatctcaggcttcccaggaacccccgggcccctcccagtcccctggcctcttccttgagccatctgagtccaggactgttccccagaagtgcctcttgccttctcagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctg

SEQ ID NO: 56973 - DNA, 1435 bp, Homo sapiens
cctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtc

SEQ ID NO: 56974 - DNA, 2028 bp, Homo sapiens
cctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtgcagagggccctgacaagcctagcgtcgtgtcagggctgaactcgggccctggtcatgtgtggggccctctcctgggactactgctcctgcctcctctggtgttggctggaatcttctgaaggggataccactcaaaggcaaggcctggtgaggggggccctggcctcatacccacctggattgtcttcctccaagtgagagaccacagcttcctgggcaggtcctgctctgtggcccagcagccccccttcaccccaacttctggccagattccaggccagcactcttgtcctcctgggaggcgtctacagggccagcccctggcactgccccaggagtgccttggctctgggtaggcccatccttcagctggctgcagactgttctgagcggtatttacatgtgcccactctcaggttgtcctgtggccatcagcttctctcccagacagaggatctcaggcttcccaggaacccccgggcccctcccagtcccctggcctcttccttgagccatctgagtccaggactgttccccagaagtgcctcttgccttctcagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctg

SEQ ID NO: 56975 - DNA, 1744 bp, Homo sapiens
cctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgggtttccataaagaagattaaccagttgcttgagaatgtaattttgctcctagggggggggcccggttcccaattagccctatggggaggcgtttaacaattcaggggccgtagttttacaaaggcgagactggaaaaa

SEQ ID NO: 56976 - DNA, 271 bp, Homo sapiens
cttcccagcttttgcttgttgtaaacagctggcagtggttacatctatatttgttaagaggcagagcactgtattttgtgtaagataaggtgctagtcttggccaggctgccaagcctgggcttttaaaataaaagttttaaagaaaaattatagcataataaattacacaattttattggaaaactgaaggtgttcaaccaatgctagtttttaaatatatttagaaatactatttcaggaaattttaactacactcattagtcttatgg

SEQ ID NO: 56977 - DNA, 484 bp, Homo sapiens
tgctgataaaggaatttcatttggctgaatttacaatttctaagaatatgaacagtgggctcaaccacactgccttacacttagtaagtgcttcataaatattagacactttttttttggtaaaaaaggcctgatttccaattgccatagagataacaatgagttcaatgagaagttactcccccctttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaacccgcagcttgttgtgtaagtacaaggaaatggatttggaataagtttagagacacacctcaactcaactctaaaggaaaagaacctgccatctggctgaaggttagacg

SEQ ID NO: 56978 - DNA, 450 bp, Homo sapiens
taagcaacagacatttatttctcatgcttatggaggctgggaagttcaggatccaggtggaggctgaccccatgtctttctgggaggtccagctgctcctggaccagatagtgccaacacaatacttctcattgtgttatgattgcctacagcaggtgaaggcctgcttcctgttttccagatggccgtcttctcattgtatcttaacatggtggaaggagaatgagaaagctcgcttgtgtctctttttataagggcactaatccagacgcggagggctcacctttacaacagctaaacctgatcaccccccagaggccccatctccaaataccatcacattggggattgtgctttgacatatgaatgtgggaggacacgagcattcagtccataacaggcaccaaggcaccaagtcagtctgcacaagtgtgtcgctgggcagaagaa

SEQ ID NO: 56979 - DNA, 2981 bp, Homo sapiens
  misc_feature (2058)..(2058): n is a, c, g, or t
actaaggggcggggccgaagcggcccagggggcgggcgtttgaaatcagtgccttagagtagaccctaaacctcattttataccttcaagaaccaattacttaatgtctcttccgtcttttccgtccccgaccccctcccagactccttcattccggtactgcgtggacggaaagccccgggtagccgacaccacgtccccggctagcgggagagagcgtggaaaaggattacaccaaactgtttaaatccaacgactcctgcttccatcctttctcctgagctagaaccaacaaacctagagagttgggcttcggaaaaactagtgttttcatttaattggatatgaagaaagaacaaatatgtacggggcaaccacgatctttacaaagaacataagttccaggaaagcaggaaccttgtctctcttgttcactgggtgtatcctctgcatatagaacagtgcctggcacataataggtgctgaattttgttctaaacactgaggacattctctgctacatttgggtcgtacccccaggtctgagtaattcaatagacttaagaagacagagcccagcagcaaccgaaacataacagagttgcaggatcagctaacgtcaatgcctgggcaaagctgctgcccagagtggaatctcactagtgaataaacaagcccaagaaagattatcatctcatttgcaaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaaggaagcatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccnatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatatgacttttctgagttatttatgtacttaaaatatgttgtcacagtatttgttcccaaatatattaaaggtaaccaaaatgttaaaatctg

SEQ ID NO: 56980 - DNA, 354 bp, Homo sapiens
gtctttactaaaaatacaaaaatcagctggcgtggtagtgggtgcctataatcccagctactcaggaggctgaggcaggagaatcacttgaacccaggaggcggaggttgcagtgagcctggtttttcagcagtttactaataacacttggatctttagcattttcttctttttcgttttaaaagacaaccttgaggagagagaaggtagatatgaatggaagaataggggaaggacaatgatttggattggtttgaaacgttggcccctaatatgttgcttttgaggagtagtatttttctaaacggagtaacacttgggattttgtaaattcaatttgatgaggatcttaga

SEQ ID NO: 56981 - DNA, 380 bp, Homo sapiens
ttttttttttttagggagacaatctaatcaggatgagatcattgtaatttgcatttctttgattgctagtgaggctgaacaattttcatttgcttaatattgttatttcctattgcgtgaagtcatgttcctgctagcactgtgatctaaaagcagggcaaggaaaggttatcttgcacatagggaaagagcagagagacaagtgcaagaaacaggggctatatctttttggactgcatcttttcatagtgagtgaaagaaaatctcacttcacgtggcttaaataaaaaaggaaatgcagtaatcaccctactgaaaaggcctgacagtacgtttggcttcagttacagcttggacctcaaatgacggcaccaggaccc

SEQ ID NO: 56982 - DNA, 780 bp, Homo sapiens
gaagagaattctaggcaggaggaacaacagtaccaaacacctgagataagagtgcttggcatatgggaggcattgcaaagaagatggcagtgatgcagtggggggaagaacagatcacaaagggaatatagtatggatatatgtacatatacatacacatatgttttataacatacatagtacagtatatatatatacacacacaccatgcaccatgcactatatagtattaaattgtgtgtgtgtttgtgtgtataaagtactgtcgttgaaactgaagtctagtgtaatatgttcagtgccataggccagttataaagtgctatgaagatctagagaaggcagagattaaattccattttttactctcagaagttgaagcatgcatatccaagttggatttactgtttcatttttgttgcaaatagtctgaattgtgaaagctttgtgtcattctgttgttccatgggcactctgttttgttctttgttctttaagcagtattggccaccgtagctgcttatctaaaatgcatgtgtttatcagatattaacttatataataattggacctattaaaggaaaaattttaagtaaatgttggtagttacattgtcatttcttgctagcaatcaaggccaagttagatcatttgaattcatatttaatcattacacactgaagattaaaagtgaacaaattaatgtcatgaataacttttttccctttattgtagtatagctgagacatttatacattacattttatatatattttaaaa

SEQ ID NO: 56983 - DNA, 6705 bp, Homo sapiens
cctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgcctgttgcccctcgccatggcctgcagagtctcgggaaagttgccattgcccggcgtatcgacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctaccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagccccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagagttctaccctcctggtgtgcatccctctggcctagttccccgagagcgttcagacagtctggggctcagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagctgcccgcgagtcggagtggagcaggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggaggccaagcgaattccgcagttaccgagagtttcgaggagatgatgggcgtggaggtgggacagggggaccaaaccaccctcctgctccccgaggccgccatgccagcgagacacggagcgagggttcagagtatgaggaaatccccaagcggtgccggcagcggggctcagaaacaggcagcgagacccatgagagtgatctggctccttcagacaaggaggctcccacacccaaggagggaacactcacccaggtcctctcgctcccccaccaccaggagccccacccttcaccgagcgccagcccgcttcacgtgcccgggggtcggcgagtcttcactcccagagggtgccatctcgccggggccgaggaggagggaggcccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctggggggagccatggactctcaattacatccaaacagtggaggcttcgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattta

SEQ ID NO: 56984 - DNA, 2167 bp, Homo sapiens
ccacgcgatcgcccacgcgtccgggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggacttttcacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattta

SEQ ID NO: 56985 - DNA, 173 bp, Homo sapiens
gatgacaaaattattttgtccttgtatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagcca

SEQ ID NO: 56986 - DNA, 5910 bp, Homo sapiens
cctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgcctgttgcccctcgccatggcctgcagagtctcgggaaagttgccattgcccggcgtatcgacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctaccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagccccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagagttctaccctcctggtgtgcatccctctggcctagttccccgagagcgttcagacagtctggggctcagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagctgcccgcgagtcggagtggagcaggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggaggccaagcgaattccgcagttaccgagagtttcgaggagatgatgggcgtggaggtgggacagggggaccaaaccaccctcctgctccccgaggccgccatgccagcgagacacggagcgagggttcagagtatgaggaaatccccaagcggtgccggcagcggggctcagaaacaggcagcgagacccatgagagtgatctggctccttcagacaaggaggctcccacacccaaggagggaacactcacccaggtcctctcgctcccccaccaccaggagccccacccttcaccgagcgccagcccgcttcacgtgcccgggggtcggcgagtcttcactcccagagggtgccatctcgccggggccgaggaggagggaggcccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggacttttcacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattta

SEQ ID NO: 56987 - DNA, 349 bp, Homo sapiens
tgtatatttagtagagatgggagtttccccatgttggccaggctggtctcgaactccttacctcaagtgatccactcgcctcagcttcccaaagtggtgggattataggcgtgagccaccatgcccgtcctgccatctaaaattggtagggagaggtagccaggtagccaggcagttgttgggaagggcaggaggactctttagaatgtaacctatcaagtgtgcataccacctctggacaaaggagtccagaatgtgcctaccctctgggttatgtaactcccatgaaaaagtcagtccccttagcctgggagccacaaccacctttcagatcttctcctacctgtca

SEQ ID NO: 56988 - DNA, 175 bp, Homo sapiens
atggtcatcaagctgggacaatccttgccaccatcctagggctaggagggagagggagggctggtttgtgaacaggcatcccttgcctctccaaggccccaagataaaaccctgacccgtcacttccacccgtggggcctgcccacctctctgacctctccgccctctctgccct

SEQ ID NO: 56989 - DNA, 204 bp, Homo sapiens
tatcttttgctgtaaagagactattttcccgaaggaaaaatggcaatttacacaacgatctgcaattagagaaattaactgtagtctgtcacttgggggagctacttgaaattaatgttccattttattttcttttagttctagtagagtgtagattttacaatttttgattgactcattttgaatgagggcacaatttttgcc

SEQ ID NO: 56990 - DNA, 329 bp, Homo sapiens
gctatcaccgctggatgggcctgagggaatgacctattccaagcgcgtctcatatgccaaagggaaaagaaacgaaggccggagagtttatgcctcttgccggaagtccctgtgaaatgtgtgtggggccaggggcgacaagcattgactggaaatccgccttttaacaggagccttattcagattgacaagtagttggcattcagattttcccatctgagctcatggccgcagttcctaaaaggctgtttgagggtcccctgtcaacatttcagatttgaaggcaccactttaagggcctttatcattatccacaacagcagcagcag

SEQ ID NO: 56991 - DNA, 354 bp, Homo sapiens
ccaaatccttaagtttacaaagctgttggaaaactttgtgtcctgatttcaacaatcacgctttgtttgaaagatgagccaagctcacagacactaaattttatgtcatgccataagctggagaggagccatttggctacagctgcggaacttcattgaggagcaaatgaaaggcacatggacgagcacgctggtgcagttcatgttcttcctgcctgtgaattgaatactgtcctggtagcagtttcgggtcggtcaggagctcaaggctggtttgtgtggctgactacggatgagcactgaagttgcctcaaagaattaaggggtgtccacaccagcctctgggggtctttg

SEQ ID NO: 56992 - DNA, 351 bp, Homo sapiens
agtagagaaggggcttcacgatgttggccaggatggtctcgatctcttgacctcgtgatctgcccaactcggcctcccaaagtgctgggatcacaggcatgagccaccgcgcccagcctaagcatatgatttttttaaaaaaattatatgacatagtatatacaatttggtaactggatttttaaaaacttcaatatatttttaatttaaaagggggaattctatagggttcagcccccagttttttcctcttttcacactatcttctttccctagacaattccatctacttctgtggcttcaattcacaactatatttttcctaccagattttacctgtcaccccaattc

SEQ ID NO: 56993 - DNA, 339 bp, Homo sapiens
tctgtatatatattttttcttgccttgttgcactaattaggacatccagtaggatggtgaataagagtggcaaaaaaagaaccttgtcttgttcccaatatagaagaaaagcatatcatttctcaccataaaatagcgtgaagtcccattttttagatgttccagattaagttgaggatgttttttattcctagttttctaagactttttctcataaatagatgttggagtttgtcaaatgctttctctgcatcaattgacagaatcataaaatagttctttagccagttaataaatgtcagatcagtctggtatgcctaaaataaattgcacttactg

SEQ ID NO: 56994 - DNA, 10542 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 56995 - DNA, 443 bp, Homo sapiens
atatcgtcgacccacgcgtccggggaagaaagggtgagcccggagagccaggaccaaaaggaggaatcgggaaccggggccctcgtggggagacgggagatgacgggagagacggagttggcagtgaaggacgcagaggcaaaaaatcgcttgaacctgggaggcggaggttgcagtgaaccgagatctcgccattgcactccagcctgggcaacaagagcaaaactccatcccaaaaaaagaagaccagcctgggcaacatggtgaaacctcatctctacaaaaaaatacaaaaattagctaggcatggtcatgtgtacctgtaatcccagccactccagaggctaaggcacaagaattgcttgaaccagggatgtggaggctgcagtgacctgaggttgtgccactacactccagcgggggatagagccagactttgtctc

SEQ ID NO: 56996 - DNA, 380 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagcttcagataaaatggggatcctcagagatcacca

SEQ ID NO: 56997 - DNA, 10124 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 56998 - DNA, 9321 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 56999 - DNA, 4042 bp, Homo sapiens
cgccgctcgctacccctcatgcctgctcccccgctccccctccctgggataccccggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 57000 - DNA, 7043 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaagggggaacgggaggaagcgaaatctccgtttcatggaggctgaggcaagagaaaatttcggagcctggatgtggaggagcccaacagcagaactaactcaggaaattgtctttcagaaaaaggccgaacgtaggctgggtctgagaatcaggctggggtatggtggaggaacctgcatgtttaaaggaacaagaaaatga

SEQ ID NO: 57001 - DNA, 3503 bp, Homo sapiens
atatcgtcgacccacgcgtccggggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 57002 - DNA, 4844 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgcccttaaaaaaat

SEQ ID NO: 57003 - DNA, 2397 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaaggaattatctttcttttggactggaaaggtgatactgatggaacggga

SEQ ID NO: 57004 - DNA, 411 bp, Homo sapiens
ctcagcagaatctgtgcctcttagatatttacggaaggtgcttgttaagccaaaggcttgtagaggtgggagtgtactgaagtccggtgcatcctgcaaagtgtgcaactgtcctgcagacgggctcttcctctgtgaatcgacccctttccctgcaatgtcttgtgcagcatttcagagctagacattcttctctgcagatgagaatctcatgctaattttccccacaccagggtgtcccagggagagatggagtacctggaggacctggagaaactgggaagaatgtgagtgccattagggctttggggggctctgtgacaattcttagtgccataagatctgcccaacatgacctggtgcatggttagtccacagctctgcagtgagtgaatgtaaaaggatttctga

SEQ ID NO: 57005 - DNA, 359 bp, Homo sapiens
tgtttggtttcaaggattctgatcacttttgttgtctgtaaacattctaactttgatgttgtagctctctttgagccaacttggttttgtaaactcggctaccaatatgtctcacaaacaccagccaccaccagaggaaaatatgcagccatctgccatattttacaagatggacatgctttgccatgctgactttctctgtgttctaaatgttggcatgtgtgcacgtgttgtaggcacacatgataaaactctccgtggttgtgtatgtctcacttttttttctgtgcttcactgcagttcactcaaacaaaagagatatcatctttcttttggatggatcagccaacgttggaaaa

SEQ ID NO: 57006 - DNA, 10724 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 57007 - DNA, 7773 bp, Homo sapiens
ctctatccttaatctctctatcccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 57008 - DNA, 7239 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatggtaaggtgctgcacattcctagactctccctgtactgagggcaagagaaaggacacacttctcggctcatcagcagccacagaggccaaagacgtggcctttaacactgcaacgtagcctaagattagcagcagagtccccgtgaaggaagtctccgtggggaaccagagtgacccttgccaagtggggcttctcagcagaatctgtgcctcttagatatttacggaaggtgcttgttaagccaaaggcttgtagaggtgggagt

SEQ ID NO: 57009 - DNA, 6750 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagctctcgcgagtcccacaaacacagcgcaatt

SEQ ID NO: 57010 - DNA, 3290 bp, Homo sapiens
gccggtaacccgctggccaatggcatccgaggcgtatggggagatcgactccaggatagtggacagaagggagaccctggtacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagttt

SEQ ID NO: 57011 - DNA, 4771 bp, Homo sapiens
gcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctcagacatcgtctgcgctgggtgcgagctccac

SEQ ID NO: 57012 - DNA, 6694 bp, Homo sapiens
taaggctttccctgctgcctcccaggctccgttccccaacccctatttctctgtcccctctgggagttgcagctaccagcaccccctctgtagtgttcctgagagggcctcatgagtcccagcgcccatgcctgcaggtcccaggtgtcctcgcattaagttcccgctgagcatcccaggcatgctgacacgctgagccctctgtggctgcttttagatgtgcagtcaagatgaaaaatgaccagtttctaagagaaagtcatcagccagacactgaaagccttctgggatgggaccccaggcccagcgctggcgcagtgagaacttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccgtctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgaggcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57013 - DNA, 6652 bp, Homo sapiens
taaggctttccctgctgcctcccaggctccgttccccaacccctatttctctgtcccctctgggagttgcagctaccagcaccccctctgtagtgttcctgagagggcctcatgagtcccagcgcccatgcctgcaggtcccaggtgtcctcgcattaagttcccgctgagcatcccaggcatgctgacacgctgagccctctgtggctgcttttagatgtgcagtcaagatgaaaaatgaccagtttctaagagaaagtcatcagccagacactgaaagccttctgggatgggaccccaggcccagcgctggcgcagtgagaacttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccgtctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgaggcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57014 - DNA, 3856 bp, Homo sapiens
gggtgctctagaggatccggaaggatctgtgggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57015 - DNA, 5446 bp, Homo sapiens
gaattccacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctctgtttgtttgttttttaacacttcctgtgctgtgcccatttataagaggaaataaaattaagctgaaatgaaaaaaaaaaaaaaaaaaatatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacga

SEQ ID NO: 57016 - DNA, 4943 bp, Homo sapiens
gaattccacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtgctgtgcccatttataagaggaaataaaattaagctgaaatga

SEQ ID NO: 57017 - DNA, 4971 bp, Homo sapiens
taaggctttccctgctgcctcccaggctccgttccccaacccctatttctctgtcccctctgggagttgcagctaccagcaccccctctgtagtgttcctgagagggcctcatgagtcccagcgcccatgcctgcaggtcccaggtgtcctcgcattaagttcccgctgagcatcccaggcatgctgacacgctgagccctctgtggctgcttttagatgtgcagtcaagatgaaaaatgaccagtttctaagagaaagtcatcagccagacactgaaagccttctgggatgggaccccaggcccagcgctggcgcagtgagaacttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccgtctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgaggcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57018 - DNA, 2937 bp, Homo sapiens
gaattccacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcaccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57019 - DNA, 521 bp, Homo sapiens
actctagtaggatcccctataaaagctacccgctctgagtagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57020 - DNA, 5127 bp, Homo sapiens
gaattccacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57021 - DNA, 5193 bp, Homo sapiens
taaggctttccctgctgcctcccaggctccgttccccaacccctatttctctgtcccctctgggagttgcagctaccagcaccccctctgtagtgttcctgagagggcctcatgagtcccagcgcccatgcctgcaggtcccaggtgtcctcgcattaagttcccgctgagcatcccaggcatgctgacacgctgagccctctgtggctgcttttagatgtgcagtcaagatgaaaaatgaccagtttctaagagaaagtcatcagccagacactgaaagccttctgggatgggaccccaggcccagcgctggcgcagtgagaacttcgagagacccgtggacctggagggctctggggatgatgactcctttcccgatgatgaactggatgacctctactcggggtcgggctcgggctcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57022 - DNA, 3278 bp, Homo sapiens
tgcagtgtctagatgatttcaagggctgtgtttaccaaatgtttgtcctggaaaccagcctgagtgcctctctgccccaaaaaggagatctcagtgagcactgtggctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57023 - DNA, 4978 bp, Homo sapiens
gaattccacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccaccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57024 - DNA, 2065 bp, Homo sapiens
ttaagcacgagaccgagcgctcgctgagtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttgtttttgtttttttttgtttgtttgtttgttttttaacacttcctgtgctgtgcccatttataagaggaaataaaattaagctgaaatga

SEQ ID NO: 57025 - DNA, 349 bp, Homo sapiens
gcagtaattatgcttgtctttggctccagagggaggcattatacttgataaagagtgtccagaggggacactctctctgtcttccaaaattctaagcaaagttgtcctgtgctctacgtggaaatactatccttattattcaaggctactcatcgtataaatatccttgaaaagatagtggagaacaaagagcagtcagtgcttctgcttgcaagatatacagaaagttttcacccaataaatatattagtagttatgttaaatataaatagtctaaagaatgtcagattgggaaaaaaatttcaatatatgttactaacaagaggcactccttaaatatggggacatg

SEQ ID NO: 57026 - DNA, 759 bp, Homo sapiens
ggaagccgctggctgggttaacctgtggcgcgctccgcggttccggcgcctgaagttttagctgcggtggcggcggcagtcgggaccgactgcaagatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggaggtaatgctaaactgcattagagttagaaagaaaaaaaggagataaatagggttctttgtttttcttcaatttgattcacgttggagagactctagtaatcactgcattcttattcaataatctacatgtggacttcaaaaaaagcaacagagtggtgactggagtctggtttggtggtttgaattcctgttctactacttaccagctgtgtgaccctaagtaaattatttaacttttcagcctgaattttctcatatttaaaattattatttgcttgtattgctatgagatttcagtgatataatacttacaaagtgaatagcacaatctttgcttattcctctttttgtatataagctgctataataattt

SEQ ID NO: 57027 - DNA, 3342 bp, Homo sapiens
ggaagccgctggctgggttaacctgtggcgcgctccgcggttccggcgcctgaagttttagctgcggtggcggcggcagtcgggaccgactgcaagatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagtgaaaaggaaaccgaatttgcatgctctttccaagccgaagaaaaacatatcatcaggtagcacaacctctgcagacttaccaaataggactaattccaacctggatgtcctcaaacacatgatacatgaagtggaacatgaaatggaagaatatgagcggtggacaggtcgcgaggtcaagggtctgcagagcagtcagggtcttacaggcttcactttgtcgctggtgagctccctctgtcgcctggttcggtaccttaaagagagtgagatccagctacgtaaagaagtagagacaaggcaacaactggaacaagtattaggtgatcatcgagagctcattgatgctctgacagctgaaattcttcgtcttagagaagaaaacgctgctacacaggcaagacttcagcagtacatggtcacaacagatgagcaactgatatcactcacacatgctattaagaactgtcctgtgataaataacagacaagaaattcaggcatcagaaagcggagccacaggtagaagagttatggacagtccagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacgtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgttggtttgaatctttctccaccaatgtcacctgttcagttacctctcagagcatggactgaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattactcccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaaaaataaa

SEQ ID NO: 57028 - DNA, 3293 bp, Homo sapiens
cgagtatgcgcgtgcgcaccgctttcgggagcttttgcacagagctgatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagtgaaaaggaaaccgaatttgcatgctctttccaagccgaagaaaaacatatcatcaggtagcacaacctctgcagacttaccaaataggactaattccaacctggatgtcctcaaacacatgatacatgaagtggaacatgaaatggaagaatatgagcggtggacaggtcgcgaggtcaagggtctgcagagcagtcagggtcttacaggcttcactttgtcgctggtgagctccctctgtcgcctggttcggtaccttaaagagagtgagatccagctacgtaaagaagtagagacaaggcaacaactggaacaagtattaggtgatcatcgagagctcattgatgctctgacagctgaaattcttcgtcttagagaagaaaacgctgctacacaggcaagacttcagcagtacatggtcacaacagatgagcaactgatatcactcacacatgctattaagaactgtcctgtgataaataacagacaagaaattcaggcatcagaaagcggagccacaggtagaagagttatggacagtccagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacgtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgttggtttgaatctttctccaccaatgtcacctgttcagttacctctcagagcatggactgaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattactcccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaaaaataaa

SEQ ID NO: 57029 - DNA, 3525 bp, Homo sapiens
ggaagccgctggctgggttaacctgtggcgcgctccgcggttccggcgcctgaagttttagctgcggtggcggcggcagtcgggaccgactgcaaggcaggttgagatgatggatctgaggcttgcagctcgcagtcccaacgagccttagggaccagggctaccaaaagggtggggagaacggtggtggcatctgtctgttgcctgggatccaggcgcccggttggggaatccttacttcaggaagcgcagccgcggctctgtgttttgagagtgcaaatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagtgaaaaggaaaccgaatttgcatgctctttccaagccgaagaaaaacatatcatcaggtagcacaacctctgcagacttaccaaataggactaattccaacctggatgtcctcaaacacatgatacatgaagtggaacatgaaatggaagaatatgagcggtggacaggtcgcgaggtcaagggtctgcagagcagtcagggtcttacaggcttcactttgtcgctggtgagctccctctgtcgcctggttcggtaccttaaagagagtgagatccagctacgtaaagaagtagagacaaggcaacaactggaacaagtattaggtgatcatcgagagctcattgatgctctgacagctgaaattcttcgtcttagagaagaaaacgctgctacacaggcaagacttcagcagtacatggtcacaacagatgagcaactgatatcactcacacatgctattaagaactgtcctgtgataaataacagacaagaaattcaggcatcagaaagcggagccacaggtagaagagttatggacagtccagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacgtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgttggtttgaatctttctccaccaatgtcacctgttcagttacctctcagagcatggactgaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattactcccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaaaaataaa

SEQ ID NO: 57030 - DNA, 3369 bp, Homo sapiens
gattgtagcgttgggggagttcaccgtgtagcaggagagaggcaaactatccagggtgctttgggaccgggagcgtcatttaaatcgatggatgtcagaggggcttctcagaaggctcctcctatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagtgaaaaggaaaccgaatttgcatgctctttccaagccgaagaaaaacatatcatcaggtagcacaacctctgcagacttaccaaataggactaattccaacctggatgtcctcaaacacatgatacatgaagtggaacatgaaatggaagaatatgagcggtggacaggtcgcgaggtcaagggtctgcagagcagtcagggtcttacaggcttcactttgtcgctggtgagctccctctgtcgcctggttcggtaccttaaagagagtgagatccagctacgtaaagaagtagagacaaggcaacaactggaacaagtattaggtgatcatcgagagctcattgatgctctgacagctgaaattcttcgtcttagagaagaaaacgctgctacacaggcaagacttcagcagtacatggtcacaacagatgagcaactgatatcactcacacatgctattaagaactgtcctgtgataaataacagacaagaaattcaggcatcagaaagcggagccacaggtagaagagttatggacagtccagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacgtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgttggtttgaatctttctccaccaatgtcacctgttcagttacctctcagagcatggactgaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattactcccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaaaaataaa

SEQ ID NO: 57031 - DNA, 1891 bp, Homo sapiens
gacgctccccacatcccagacgatgggcggccaggcagagatgctcctcacttcctagacgggatgatggccgggaagagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacgtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgttggtttgaatctttctccaccaatgtcacctgttcagttacctctcagagcatggactgaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattactcccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaaaaataaa

SEQ ID NO: 57032 - DNA, 1908 bp, Homo sapiens
ggaagccgctggctgggttaacctgtggcgcgctccgcggttccggcgcctgaagttttagctgcggtggcggcggcagtcgggaccgactgcaagatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattactcccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaaaaataaa

SEQ ID NO: 57033 - DNA, 224 bp, Homo sapiens
caacttctttgtgtctgaaacattcctttatgtacttttctcttctgtataggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggaggtaatgctaaactgcattagagttagaa

SEQ ID NO: 57034 - DNA, 344 bp, Homo sapiens
accgacgatacatgcacacctacgctgctatcctgcccctgtgcagatgccaccaacctgccttgctggcaccctgcccctgatgtgagtgtgccctgccgcacagcctctgctgtcaacacatttggctagacaccaccttgcctccacagggatgttactaccctatccccaccagtgctctgcttccaccaatgcatgcccgcaccacaagccactgctgctggcatgcacatgtgagtgcaggccctgctgccaccaccccaatgaaacattttagctggcatcctccactgagtgttattgtcagcagaccaggaacgcattcactctttcagcacagc

SEQ ID NO: 57035 - DNA, 386 bp, Homo sapiens
cagcctagggttgttgcccttctctgaggcacccacagacttctgagcaggcacagtcctaacctccccattggggccagctttcagagtacagctttgcctagagcaaagtgagtgtggggcggggcgggggtcacgcagtggctcagctgtgaccaaaaaacgtcagactcttcactcttagatgtttatagaaaactgtaatctcagaatgaaaaggcaaatgttgaaacttctttcaagatgacttctttatttttgggttttgtttgtttgttttgggagagtctctctctgtcgcccaggctagctgtggtgattgatagagctcataaagctcattctccagtggcttttctcctagttaatatgcatgtgaagtgttt

SEQ ID NO: 57036 - DNA, 1039 bp, Homo sapiens
aaaagaaagaaaaaaaagaaaaattttctgcaaagggtgtcaatgttaatattataataattctttaacaatgaattcctctccaaatgcacttagagaaatgtacataagtgtgagaaatcaccattaagtacacttaaatctacacattgactagttctagctgaatttctagtttatgaaaaggtattaatgtttctagtttatgaaaaggtaatgaggaaaactttctttaaaagatgtgtttaacagccaaatcagatatactgaacagacataaaaaagtaacaatatttttttcacctcaggcctttcccctggtttgatctgactgctgtgcatactcaaggaactccgtttagccagcatctctcaagtagtcctgttctccaagaccaccttacccatctatactgtgcttcatttggcatctccctaaccaaagaacagccagtcatttccacaggctttccatcccaataagagaactcaggaatcaggattttttcccactcacagattttccctataatagttgtgccctgattatcacaattgactgtgggagtcttgtggctgtattgtgtttgccacatgatagacatcaggaattataaaactgtactgatgactctttaaaatgtagaataaaacaagtggtcctatccatcaatatgtatctggctctcagaagcaactagtgaaactacacaacctaacttaagtaagctgctcccgcagaaaagtcttgttaatacaaattatttctcttctaaaattaaagaagttataatgttataagttttagacaattacatactgcagcttcttttccaataaatcaagtttcaatccatttgccagcagtaggtagctggaaaaagatacagtttgattttctcacaattttggacagagaagtgaaggtatggtaaaccatcttaattgaattatggcttgtatcatgcttattttgactatatatgactgttctggtactatcttatttacagctgttcccatttaaaccatttaaaaa

SEQ ID NO: 57037 - DNA, 592 bp, Homo sapiens
agtagcagggtatccagtagggactgagggatctgccccagtagtgaagtataaggaggtatcagaaggtttatgcctgtaatcccagcactttgggaggctgaggtgggaggatcacttgaggccaggagctcaagaccagcatgggcggcatagtgagaccctatctctacaaaaaataaaatgaaaaacaaacaaaaaaaataagatggaagctaggcaggcccaagtactaaatgctataggggaaaagaagagtggcattcgttcaacaggcgtgagagagaagccttcatagaagacatgttgtttgctattaatagatctctgatggatgatgaataaaacagaataagcaactacatataagcaggagtaaccataaccctaggattatagtatactaggagaaaaaaaaaatggtatattgttaacctcatcaagccaccaaatgttaatgtggaaggaaaatattgggtctggtttatgtagcttctgctatttgaccccacagttggtttggtttacttcttctattctaaagtaatacagattaagtttagaaaacaatcttgaggtaaacaaataggga

SEQ ID NO: 57038 - DNA, 422 bp, Homo sapiens
tcttgaatacgttaagaaagtcttgtttgtatagaagagtttcaaatcatgtgagtgatgaagggacccttctgttgaaccttggtgtgcattttaggtccattttgggtttactcctttgtgctgcttcatgatgccttaggacaaggacaaggcctaggcctccttgtctcagttccctcctgctctctctgttgccctcctccttccacctggagcatggcccagcatcaggttggcacatgctgtgatcagctacctccatgtaccacaccaagcaaagctctctgggtgacacagttgccaccaccagggcactgacccttactctgtgttctcctagctcctcctgagggtgctgtaggagacatctgcaaaaaagaagatgctggcaatatgccatcaacctcagaggggagtat

SEQ ID NO: 57039 - DNA, 311 bp, Homo sapiens
caaggaaacgaaaaagcaccagctctttggggtcagggttaaggctctaacacagaatctggcatataaaaagtattcaagatacttttaagggccaggcgtcctggctcacacctataatcccagcattttgggaggcagaggtgggcgaatcacttgaggtcaggagtttgagaccagcttggccaacatggtgaaaccctgtctttactaaaaaatacagaaagggcatggtggtgcacacctgtagtcccagctactcgggagactaaggcacaagaatcacttgaacctgggaagcagaagtagtt

SEQ ID NO: 57040 - DNA, 486 bp, Homo sapiens
gaggctgtttttcatttttcggagggttcaagactttaataagattgattctggccatactaggaagttgcctaatactaccttgtctcttacctctccttgttagaaacattcagtcaactatagaggcaatagtagctaggcaaactaccagtcagctaatggctctatgtaaatgtcaacctttgtctaaagaagaaaacttgtctcttcatgcaaaattaaataatagtgatgcctcctattaaatttcttttataaaaggcatcaaaggggggaaactgaggcagaaatttaaaaataaatatgcattcattcactccaagaaaagttaacaggcaaggcaagggttaaaaagaaaagaacaagttttcctcggcctagcaagctcacttcaaggacagttataagataatgttgtttgagaagccaagtccaaaggaatgggttccagacatccctcccctctagaacaaggttgaagga

SEQ ID NO: 57041 - DNA, 611 bp, Homo sapiens
tggtcatattttgacttcatgcatttaatgaaccaaactaaaggtaaatattttattttgattcccaaggcagacttgtgggtacccaagttcctcagcccatctttaactcagtaggatgtggcatctccattgaggctcttcatggaatccctggaggtgaaacctcggtgtccggttgctccaaaccagtgctggtgggattcagttttctggacccatttctgggtgaagtcaaggaatggaggcgggcggctgtcaagcgtctctgttgctcaatggggcaggccagtcccagcggcgacttagaggtggctggctgggcgtccctacaggagaatgggccacagggccagcggggccagcaggatgagcaggcctggtttggggtatgggccgcaggcgtggagctcgatgctgggcaggggcctgctcactgacgagttgccacccgggattggggtaggggtgggcgcggtggtctcgggctctgagcggctctgcaccggcaggagcaggactggcagcagcagcagcagcgccagtgcggatcgggccgccatggccaagcgctccggctcgtcccgtagcagtgccgcggcggcggccgc

SEQ ID NO: 57042 - DNA, 334 bp, Homo sapiens
tgtgtgtgtgtgtgtgtgtgtgtgtgtgtgtgtgtgtgcatctgcaaaccctgcacttcattatccaaaaattatttgatattttataatcagagaaaatgctatttttaaaccctaccactgctgaccaaacaacaatcacaacagcataacactaaatactgttcaacaaatctattttagtgtagtaattaaataattcctaaaattatagacatccctaatattctttcctttagtgttcctcagagtgcaatctgtggagcaactaccttgaagaaatttggggaatgagacctggaaacctaaatgtttagtatgtgctctaggtgac

SEQ ID NO: 57043 - DNA, 738 bp, Homo sapiens
ctcagagtacagacaaaaaggaaggcttgatcagcatgtggtggatctgaagattcaaagaattgccgcggctcaaaagtagacattttggtaaatgtgaagagtgagattcaatgaagatgataagaaatgaaaggtgttaccaaaagtgagtatgtgcagctatgcttgtcacacaaagtaggctttaagtcaaaaaagcacaaaaatagaaaataaaggtcattataaaatgataaagggatcaattcagcaagaaggtaggacagttgtcaatgtaaacacacctgacacaggagccccagttattaaagtaagagttattcgagcaacagacagagacagacaataatagctggggactccaaaacccactttcagcaacagacacaccctctaggcagaaaagtaacaaagaccagactgactccaagagaagtcaaagggacctcacaggtaattacagaacatttcacccaccaactgcagaactgcattcttctcatcagctcacaaaacgttctccaggatagaccacattttaggccacaaaacaaatctcaaaaaagcatttaaaaaatgaaaatcatagcaagtatcttctcagaccaaaatggcataaaattaaaagccaataacaagaggaacgttggaaactctctaggtacatggtatataaataatggtaatggtcagtgaaaaaattaaaaaggaaagtaacaaaaacatttcttgaaa

SEQ ID NO: 57044 - DNA, 437 bp, Homo sapiens
ttgtcatagagtaggagatgattgaatggcatttggaagaggaattcattatccatagtgacaagtggggagaggcattcctagcagaggaagaaaggtgagcaaagggagagagttgtataaacatcatggagaattagaggattgtagggagagagggactggagagacatgtgaggtcttggattttctcaggagttggattttatattctaggatttggattatatttttaaagatatggggtctcactgtatcacacaggctggagtgcagcggcacaatagttgctcactatagcctcgacctcttgggctcaagggatccttgcacctcagcctcctgagtagctgggactccaggcatatgcccacctctggatttggattttattttgtaagcactagagagttatagaagactttaagaattgaagt

SEQ ID NO: 57045 - DNA, 286 bp, Homo sapiens
agacttcatgtgcaaatgtcaacctctctcccaaacgaagctttagaaatttggggcgcatggtttttactaaagccccttctaagtgctgctcatcagaagatttacaacaatcctaaagacaatcagctaacacaagttacaccactgtaaggaaaacagccacgcaaatagagcaaggtgctgggtgatttcgttagaaacaatgttttcaatggacggggtctcagtaaaataccaaacgcagccccctacccttggcccttcaagtaaacagtttccccta

SEQ ID NO: 57046 - DNA, 464 bp, Homo sapiens
ctcccagcaagcacggcatggtgggaaaacgtaaaaatgcccccagcatgcaaggcatggtgggaaaacataattataatgtcccagcaagcacagtatggcaggaaagcctgaagaacgccccagcatgcccggcatggtgagaacacggaaagaacctcccagcatgcaagacatgatgggaaaacgtgaagaacgccccagcacgcatggcatggtgggaaaacgggaagaatgtcccagcaagcccagcgcacagtatagtgggaaaagtataaaaagcatccaagtacacaacgtggggcatgaagggaaacctgtcttcttacaaagatgctattcagaagcataggggcacgcttccctcaagagacttttcaggagctcttttgtggactgcaccaaatcttctacatggacgattgtgtcatccgcaaataaagacttttaattcttccttacca

SEQ ID NO: 57047 - DNA, 327 bp, Homo sapiens
ttgtatttttagtagagacagggtttcaccatgttggccaggctggtctcgaactcctgacctcgtgatccacccacctcggccacccaaagtgctgggattacaggcgtgagtggtttttatttcttaggccggtttcctccatatgatcttgcagtagacattaatttctttcctttttaattaaaatactgtttgtatttcacattttgatgtttgttaagatttgttttatattgttttttgttttgtcttgtgtgatagtcttaaatccctagttagataataactggagagtaccatgtttctatatatctctcagtgact

SEQ ID NO: 57048 - DNA, 1245 bp, Homo sapiens
acgactgcctcactaaaggaagctaaaagctgtgctgatgcctcccagacgagcctcgttggaagcacagaaccttcacggctcggagccgctgacaccgtgacaaagggagccctgctcaggagaaagagcaaatgagaggcagttgcactttttcaggtgtcaggctggaggaagccacttgaagatgaatctacctctgccttaggattgcctgatggcctgtgccattccatgttatatctactgatttgctccctgtattcaaagattttttttttttttacttaattctctcttactgaccctgagagtgaccatatttttaaccaatttggtcttcagcctcaaaacttagctctttccttttgtggtccccgaatcctatcacgtgtcatggtggctgtgaagatgtttgccaagcctgctgagaaggctcatctgtggcatccaaaagcagagatttcaactctggacccctgtgacctgcctttgtaattatggatacccagcactgttttgaaatatcagtggacatccagtttttaaaagccctcagagctttgggagacacccctttatctctctggcatgtcagagaaccgattcaacccttctcatctcctcctccttccctctcttgggccatcaggatgcggcagaacttcactgtgcatgtttttacagctcttctccagtaatgctgccatttccactgcagaccacaggataaaaggaccgcttcaccgtggcccaggatacccttttaagtaggagagggagaagaaagtactgctttgatctaaaattaagcaaacgtttcttcaataaacccaccatgagacttgaccactaatggtgaccagcagtggctttgtcatggccctgcccactgggggcaggcacatgccggggccagggcaggctgccagctggtgagcacgaataggtggctggtggagcgcatgcagtgggaagggcagatggctccattttgatttgttagcaggccacttcctcggaaggggctttcccttcagtcgggtctgcaccgccagcctcagctgtcttggagcagatgtgtatagttagagatggggaccttttcactgtaaatactgctcacatgttcctaggctgactttactatgtgcagagcctcttctcaaatatccaaatcccctctgttgggtactacagaacagatgttaccctgcctcctattacattaatttacgaacttta

SEQ ID NO: 57049 - DNA, 1336 bp, Homo sapiens
acgactgcctcactaaaggaagctaaaagctgtgctgatgcctcccagacgagcctcgttggaagcacagaaccttcacggctcggagccgctgacaccgtgacaaagggagccctgctcaggagaaagagcaaatgagaggcagttgcactttttcaggtgtcaggctggaggaagccacttgaagatgaatctacctctgccttaggattgcctgatggcctgtgccattccatgttatatctactgatttgctccctgtattcaaagattttttttttttttacttaattctctcttactgaccctgagagtgaccatatttttaaccaatttggtcttcagcctcaaaacttagctctttccttttgtggtccccgaatcctatcacgtgtcatggtggctgtgaagatgtttgccaagcctgctgagaaggctcatctgtggcatccaaaagcagagatttcaactctggacccctgtgacctgcctttgtaattatggatacccagcactgttttgaaatatcagtggacatccagtttttaaaagccctcagagctttgggagacacccctttatctctctggcatgtcagagaaccgattcaacccttctcatctcctcctccttccctctcttgggccatcaggatgcggcagaacttcactgtgcatgtttttacagctcttctccagtaatgctgccatttccactgcagaccacaggataaaaggaccgcttcaccgtggcccaggatacccttttaagtaggaggtaactattcagtttcgtagtggcccatacataaacttgattatgttcttcgttgctccaatatactatttgtgtgttttgttttttccagagggagaagaaagtactgctttgatctaaaattaagcaaacgtttcttcaataaacccaccatgagacttgaccactaatggtgaccagcagtggctttgtcatggccctgcccactgggggcaggcacatgccggggccagggcaggctgccagctggtgagcacgaataggtggctggtggagcgcatgcagtgggaagggcagatggctccattttgatttgttagcaggccacttcctcggaaggggctttcccttcagtcgggtctgcaccgccagcctcagctgtcttggagcagatgtgtatagttagagatggggaccttttcactgtaaatactgctcacatgttcctaggctgactttactatgtgcagagcctcttctcaaatatccaaatcccctctgttgggtactacagaacagatgttaccctgcctcctattacattaatttacgaacttta

SEQ ID NO: 57050 - DNA, 1458 bp, Homo sapiens
acgactgcctcactaaaggaagctaaaagctgtgctgatgcctcccagacgagcctcgttggaagcacagaaccttcacggctcggagccgctgacaccgtgacaaagggagccctgctcaggagaaagagcaaatgagaggcagttgcactttttcaggtgtcaggctggaggaagccacttgaagatgaatctacctctgccttaggattgcctgatggcctgtgccattccatgttatatctactgatttgctccctgtattcaaagattttttttttttttacttaattctctcttactgaccctgagagtgaccatatttttaaccaatttggtcttcagcctcaaaacttagctctttccttttgtggtccccgaatcctatcacgtgtcatggtggctgtgaagatgtttgccaagcctgctgagaaggctcatctgtggcatccaaaagcagagatttcaactctggacccctgtgacctgcctttgtaattatggatacccagcactgttttgaaatatcagtggacatccagtttttaaaagccctcagagctttgggagacacccctttatctctctggcatgtcagagaaccgattcaacccttctcatctcctcctccttccctctcttgggccatcaggatgcggcagaacttcactgtgcatgtttttacagctcttctccagtaatgctgccatttccactgcagaccacaggataaaaggaccgcttcaccgtggcccaggatacccttttaagtaggagagggagaagaaagtactgctttgatctaaaattaagcaaacgtttcttcaataaacccaccatgagacttgaccactaatggtgaccagcagtggctttgtcatggccctgcccactgggggcaggcacatgccggggccagggcaggctgccagctggaataaaaacctgaccattagaccgagcgtggtggctcacgcctgtaatcccaacactttgggaggccgaggcaggcggatcacctgaggtcaggagtttgagaccagcctggccaccatgagccagatcaaggaaagagacaggaaagcagatgattttacctgccttccctaagtgcactcgggaagagaaggatcatctcaaaaagggttaaggaatgagatcatggaaatcacttacacacgcggtcgcggcttggacttggctagtgaggccggcctgcccactctgcttccattcactcagacacagcttgggcttttcctccaagtgctggtagcagtcatttatgagggaggaaaggagcagaataaacacacttctcagcaaaaaaaaaaaaacacacaccaaccaaaacccacaacaaaacaaacccggggctctacggggggcaaaaagactgaagccagacgcaagtccgccccctcttccgggaaccccccaaggggacaacacgcgcgc

SEQ ID NO: 57051 - DNA, 953 bp, Homo sapiens
ctctctccacactggcctctagtgtgtttactgtgtcttctcagtttctaagtgctcttccaaaatgtgaattcttttgtggtccccgaatcctatcacgtgtcatggtggctgtgaagatgtttgccaagcctgctgagaaggctcatctgtggcatccaaaagcagagatttcaactctggacccctgtgacctgcctttgtaattatggatacccagcactgttttgaaatatcagtggacatccagtttttaaaagccctcagagctttgggagacacccctttatctctctggcatgtcagagaaccgattcaacccttctcatctcctcctccttccctctcttgggccatcaggatgcggcagaacttcactgtgcatgtttttacagctcttctccagtaatgctgccatttccactgcagaccacaggataaaaggaccgcttcaccgtggcccaggatacccttttaagtaggagagggagaagaaagtactgctttgatctaaaattaagcaaacgtttcttcaataaacccaccatgagacttgaccactaatggtgaccagcagtggctttgtcatggccctgcccactgggggcaggcacatgccggggccagggcaggctgccagctggtgagcacgaataggtggctggtggagcgcatgcagtgggaagggcagatggctccattttgatttgttagcaggccacttcctcggaaggggctttcccttcagtcgggtctgcaccgccagcctcagctgtcttggagcagatgtgtatagttagagatggggaccttttcactgtaaatactgctcacatgttcctaggctgactttactatgtgcagagcctcttctcaaatatccaaatcccctctgttgggtactacagaacagatgttaccctgcctcctattacattaatttacgaacttta

SEQ ID NO: 57052 - DNA, 373 bp, Homo sapiens
acaaaattagtccaaaatagttctcctatttctttttattcccactggatagtactttcttgcttgctctaattgctgttctgttctaaaaaaatgtctgaacttgacttgtgttaattttctttagttcccttaactgtctgggcactgaaacgggtatagctattctcaatgcattctcacttgtcacaaatttgttattttgtatggtttagaaaatcagtgcttatttgaagcagaactaggacttaggagttcttcatttgcatatttgtagttgtcacattgtgataacttgaatgactaagtgtcactaaagtctaccagtatcctataagattgcctcattttctgtgtcagtcttgatagagac

SEQ ID NO: 57053 - DNA, 1896 bp, Homo sapiens
  misc_feature (1)..(1): n is a, c, g, or t
  misc_feature (1776)..(1776): n is a, c, g, or t
  misc_feature (1875)..(1876): n is a, c, g, or t
  misc_feature (1881)..(1881): n is a, c, g, or t
  misc_feature (1883)..(1883): n is a, c, g, or t
ngagtgatactctgcctcaaaaaaacaaaagtattttcaggacaaaggcatgtgagtgtgcagtctctgtaacctggcaggagccagtccatggtcagtggtcctcttatgaggagaaagttactggaatcagtctcttgtccagtcaaagctgtagttacggctggtggaacagggttcccgttcatgtctgtgaactgggtgagctgtgatcattttaacattgcttatctttaggtcagtgcttgtttagttgttgaataaaaagaaaaaccttgtggcagttagaacacagtttgttatttaagtttaggggagtgtgacttaacccttgactggcatggcctttggtcctgtttataatctgggatcttattgccaacaagattctgttctgtaagtcttatgatctctattttaacattgatcttggtcagtttttgtgtctactcaactggttacatttgagttaccacaaaagagggagggtataatgaggtgtgtctgacctcccatcctgtcctggccaggaactcagttttaaggttcttctgggatccccttggacacaaggggtccattcagtcagtgagggggcttaggactttatttttagtttacagatcccaatccagacctacagaataagaatcttcattccaggtgatttgtatgcacagtaaagtttaaaaagcattggtttaggagaatccaagattcctttgggaaagttctcagatgtcaaaataggggctctgcatattatgaatttcacaattaacttctcagcatactatactggttatttggtattcatgttaagttagatggttctcatcatgctaaacagtgcttcagattgcagttactctaagcataagaccctatgtcctagggtttggaaccaactccttcattgctttggtgaattagacccttttaattgtgattgcagtagattagaaaggagtccatctcccaaagagtattcaagttttagaatggaagctgcttttcagtcatcactggaattttcctacgagaatcacttacataatctacacaaccaaatgcagaaagaaaacacagggtgagttaaggaacaaagttaacatttcatctgcttggcctctgagcttgtacctgccagtcccaatgttactcggatcaaaaatgtaggatgttaaggaaaatggtgtttgtatgttttgttagtaagaattaatatggaaataatttgcaaagactggattccagtgaacttcttcaaaatcacaaaagctcagctttaggcaagatacacacatgttcagataactggatatagaagaaagagttcatcatctcaataaaaataatccatacttgtggctccaattaagaaacacaaaactttagtgtacattttggtttcactttgtttctttgttttttaccacttgcatgaacaagtaaatgatgcagaaaaacaagaagggtgattcttgcagccctaatgaacagacaccatcagaacaccaaagagaggcgacttaattttgtgagacagagccattttcctcctttctgtgaagtatctctgataatgtacagttttatgaggaaattatatggtctgggccaggtgtggtggctcacgcctgtaatcctagcacttggggaggctaaggtgggtggatcacttgaggtcagtagttcaaaaccagcctggccaacatggtgaaaccccgtctctacaaaaaatacaaaaaattagcgtggtggcacatgcctgtnatcccagctactctggagactgaggcaggagaatcgcttgaacccgggaggcagaggttgcagtgagccgagattgtgccactgcactccagcctgggnnacagngngagactctgtctc

SEQ ID NO: 57054 - DNA, 2492 bp, Homo sapiens
  misc_feature (1)..(1): n is a, c, g, or t
ngagtgatactctgcctcaaaaaaacaaaagtattttcaggacaaaggcatgtgagtgtgcagtctctgtaacctggcaggagccagtccatggtcagtggtcctcttatgaggagaaagttactggaatcagtctcttgtccagtcaaagctgtagttacggctggtggaacagggttcccgttcatgtctgtgaactgggtgagctgtgatcattttaacattgcttatctttaggtcagtgcttgtttagttgttgaataaaaagaaaaaccttgtggcagttagaacacagtttgttatttaagtttaggggagtgtgacttaacccttgactggcatggcctttggtcctgtttataatctgggatcttattgccaacaagattctgttctgtaagtcttatgatctctattttaacattgatcttggtcagtttttgtgtctactcaactggttacatttgagttaccacaaaagagggagggtataatgaggtgtgtctgacctcccatcctgtcctggccaggaactcagttttaaggttcttctgggatccccttggacacaaggggtccattcagtcagtgagggggcttaggactttatttttagtttacagatcccaatccagacctacagaataagaatcttcattccaggtgatttgtatgcacagtaaagtttaaaaagcattggtttaggagaatccaagattcctttgggaaagttctcagatgtcaaaataggggctctgcatattatgaatttcacaattaacttctcagcatactatactggttatttggtattcatgttaagttagatggttctcatcatgctaaacagtgcttcagattgcagttactctaagcataagaccctatgtcctagggtttggaaccaactccttcattgctttggtgaattagacccttttaattgtgattgcagtagattagaaaggagtccatctcccaaagagtattcaagttttagaatggaagctgcttttcagtcatcactggaattttcctacgagaatcacttacataatctacacaaccaaatgcagaaagaaaacacagggtgagttaaggaacaaagttaacatttcatctgcttggcctctgagcttgtacctgccagtcccaatgttactcggatcaaaaatgtaggatgttaaggaaaatggtgtttgtatgttttgttagtaagaattaatatggaaataatttgcaaagactggattccagtgaacttcttcaaaatcacaaaagctcagctttaggcaagatacacacatgttcagataactggatatagaagaaagagttcatcatctcaataaaaataatccatacttgtggctccaattaagaaacacaaaactttagtgtacattttggtttcactttgtttctttgttttttaccacttgcatgaacaagtaaatgatgcagaaaaacaagaagggtgattcttgcagccctaatgaacagacaccatcagaacaccaaagagaggcgacttaattttgtgagacagagccattttcctcctttctgtgaagtatctctgataatgtacagttttatgaggaaattatatggtctgggccaggtgtggtggctcacgcctgtaatcctagcacttggggaggctaaggtgggtggatcacttgaggtcagtagttcaaaaccagcctggccaacatggtgaaaccccgtctctacaaaaaatacaaaaaaaaaaaaaaaagaaaaaaaaaaggaaaaaaaatttttttgggtctggtggccccctttttaaggggactttcccccgggaaaaattcccgggttttttccaaaggttcctttgggggcccccatctaattttaagggacccttttgtaacaaatttgtgttgtctcaggtcgagaccagggtgggaaaaatttccggcacaaattatattcccaaggggcttgggaagaagccgggggtgggctcttacccctcttatattttccgtggtgtggcggcccccgggcggtttttcactcaaccatatctcttgggggggtcaccaggggtttaaaaaattaggagaaattcaaaagtttgccatataaagaaaatccccggggggggcggcggggcacatattccccaacaccaaagagctctgggcgacgggcacatagggtggacgaaatattaaaaaaggttttaaagggtttgtggaaaactcataaaggcatggggggccatgaggaggggagactactggaacaaaagggaatagaggaactgaaaggggctaagcggggatatgagatggattaaagggttacgctaaccataacgcgttgagtgatagaaacacacggcattggcggtagtgagaactaggtagtagataaataagatgggacgagcgtaaatgagctaacaagcaaatggtagggagatatacgagactgttcatgtgtcgagctcgtgtctt

SEQ ID NO: 57055 - DNA, 164 bp, Homo sapiens
  misc_feature (5)..(5): n is a, c, g, or t
  misc_feature (123)..(123): n is a, c, g, or t
  misc_feature (161)..(161): n is a, c, g, or t
  misc_feature (163)..(164): n is a, c, g, or t
cagtncttaaacctcaaggtactaagaacagtaaagagttaatgtttaaaatggtacctggcaaatggcaaatgctaaatgatagaacgaatgtgtaaggtggactggaaccaggaggaaccncaaatagagatctatcagttgcttactgcaccagcccnann

SEQ ID NO: 57056 - DNA, 246 bp, Homo sapiens
cagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagcta

SEQ ID NO: 57057 - DNA, 340 bp, Homo sapiens
aatatataagtacatgtctcatccattagaacaaagatgttatgtcatatagcttttgagaaatctcactgtacagtcatgggagaatatgaataaaatagacaaataatgtcttagtattataaaatgaatcttacacacctgaaatggtcttccccctcacccccaccccagggtctctggaccatactaaagaacccactcatataagaggatattttctgaccacagtggaattaaattagaaatggtttaaataaaaactagacctagcactttgggaggccaaggcgggcggatggcttgagctcaggagtttgagaacagccaggggcaacat

SEQ ID NO: 57058 - DNA, 343 bp, Homo sapiens
tttagtgaaggctgaatgaggactttggaatccagacttcccccaccgcgggtctgagaagcaggtttttgtaagattgtgcttgctgtattcctcactttcctggtaagagacactggttatgcctctggacccctttcttccgccctggggtcttgagatacccagaaaaagagtgagtttatcagcatattacttaagctgggaaatactgctgtaggttcctttgctgcatccatttggctgtaactttcagctatacaacccaatctatcatcagtgtcagggaaaatatgggggatgatgcattacagcatgtgaccccggggagggcactgagagc

SEQ ID NO: 57059 - DNA, 283 bp, Homo sapiens
caggtcctcgccagacaggatttaccagtgctttgatcttggacttccagtctccagaaatgtgagaaatgtttgttgtttaagccacccagtctgtagtatttttcctatagcagcccaagcagactaagacatcgtaaatgggacacccttttctaaacctgacacttattagtagagtataatcaaagtctgagagagtattagttcagagcagcaaaaagcacagatgtaccattatctttgaggttcacattcctacacccagcaatcccattaagga

SEQ ID NO: 57060 - DNA, 170 bp, Homo sapiens
caggtcctcgccagacaggatttaccagtgctttgatcttggacttccagtctccagaaatcatagaccctgacattcagctccaataatggatgtcccagtatgccctgaatccaaacaaatgcctgactgcaataataaacaaattatgtaatctgaaataaataggt

SEQ ID NO: 57061 - DNA, 417 bp, Homo sapiens
aatttcatgtttctaccccacagcttggcagagtaagtttggcaaaaaccaggattccatccagacaattgattccaaagcctgagtccataaccaccatgccagccctcctcccaggctacccacattatagccccatgaagtggcttgaccctattattctccctcttctacagatgaggccttccacattcagggaggggaatcaacttgccaaggacacacagccaggctggggaaaggtcgtgatgtgctcccaggtctctgtgggctggagctttttttcctagcccggtggaacagcagcatccaggacacatttgccctcagccccgccctcggagattcttccagatcccttcgggaatggtctgcttcccatctccggatgggtgacgccaactccacccggacact

SEQ ID NO: 57062 - DNA, 350 bp, Homo sapiens
tcttgccagagaaccatagcttttggatatttacaaagcttctgaataaatgcaaaccaatagtgcacatatgaaatgagaaaatgattcacttctttccatataaactattaattaacttgaataatgagaactcagagccgggatttttaccatttttttttccatttgaatgtcgaagacacttttttctcttcttaaaatgctttaaactgtatttataaaaaaaatgtcggccgggcgcgatggctcacgcctgtaatcccagcactttgggaggccgaggcgggcagatcacaagatcaggagatcgagaccatcctggctaccacggtgaaaccccgtatcta

SEQ ID NO: 57063 - DNA, 981 bp, Homo sapiens
tgaagctgtattcatctcatttttttgctgctttctaattttgcgagtaccctggcatgggaataggaaaaagggggtgggtagtggcaaatttctgaagagaaatatgtcatctctccttttttgcccccgctaacaaaagtcgaattgggagcttttgtgtgttttctttttgttttttggttggttttgtttaaccctttaccttgtgtccccaaacttgggacagtatactttcttttgccccttactacaggtgaaccttcctaaaagattttttctttttattctccgtaaaacatttaaagcattctttaatgaaatagttttttaagcaggttgtgtaatgttttccatgtaacagattggtttatatatagtttggctgcttcttgctaataatgaagggttttctctcctgatattgtctgagaatctatcatagatgaggttagattgcctttggaaagatgcttctagttaattcctgtcctatataattagttgaattcatctgtgaaggatgtgaatttttctttgatctttttatttcatgagcagctttgtgagtacattctcaggtctaaagtcctcaccctcttctcctattcccccagggcccccagtgaaacacacacatacattaaacagtgcagtttgttatttcaggcctttttctttgcatttatgaaagtaggtcggcatgctgcctcacacctgtaattccagcactttgggaggccaaggtgcgtggattacttgagcccaggagctcgagaccagcctggccaacatgatgaaaccacgtctctgctaaaaatacaaaaattagccaggcgtggtggcacgtgcctttaatcccggctacccgggaggctgaggcatgggaatcacttgaacccaggaggtggaggttgcagtgagctgagattacaccactgcactccagcctgggtaacagagtgactgtttcatttaaaa

SEQ ID NO: 57064 - DNA, 302 bp, Homo sapiens
  misc_feature (99)..(99): n is a, c, g, or t
  misc_feature (120)..(120): n is a, c, g, or t
  misc_feature (122)..(123): n is a, c, g, or t
  misc_feature (128)..(128): n is a, c, g, or t
  misc_feature (225)..(225): n is a, c, g, or t
  misc_feature (234)..(234): n is a, c, g, or t
  misc_feature (242)..(242): n is a, c, g, or t
gatcaaatcggagctgtgctggtcactggtttgagttgaaagttggggctcaaggctcaaggactttccttccacccttgtcccccgagacctctgggnatccccaaatcactcccagantnntaggnctctgcaaagtctgcttggaaaaccactattctagaacaatgtaaacctctggcctcatcgtgtctggtattaaaccatgccattccaaggcactgnatggaaacncactttgncagacaccccagaaggcccctgactcaggccactctgggggctggaagacaggcatgatc

SEQ ID NO: 57065 - DNA, 430 bp, Homo sapiens
aagcaaggtcttacatacacttaggttctgccatttacatgcacaagtgagatttgaatagtggaagcaaggcagaggctgccttcctgtcccatttgctgttgttgctggtaagcaagattgaggacagagggcatgtactgtggtagtgtctgtccctagcttcctggcatcaagaggtggtggaggcagcagaggatgtggatccttgggtagcaggcatggcggcgtgtctttgaactcagcagttccagtagtggctttctggaggcccatcctagaatcccgtcctcccaccctttcaatcactttgtattacttcattttctgtattgcatttctgtgtgcttataataaccaactttctgtattctgcatagaacactgcctctacgaggtcataaacaatgaagaaattcctgtcttgctt

SEQ ID NO: 57066 - DNA, 380 bp, Homo sapiens
ctgggacagagacctttgcattgctccatgtgttggcttcagctgggacagagacctttgcattgctccatgtgttggggcaggtcttccatttcaatctcctctgccctaatttattagccatacttgtgctatttattacttttaaaccctaatccttttttccgtaatttgtttacattttgcagagtgccagcattttacaatgtgtcttttatgtctcacagaggtcatcattaagttagacctttggcttcatgtgtctcccgagagatggtttataaaatttgcatccttctggcacaggtggtgtggcttagggattagaacacagcctgcctgagttcacacctcatctctcccacttaacactgataatt

SEQ ID NO: 57067 - DNA, 1012 bp, Homo sapiens
cggccaaacttcggaacgctgcatttgggaccaaatactgacggtaagaccgcgtcacaaggggagtaatcaccccttcccaagcgagcttccttaccgggacccgtgttccaacggtggcaagggacgcaatgcgcggcccagcagatggacaagaaaaggaccgggctgtctcatggaccttctctgaggagaatgtgatccgagaatttaacttaaatgagctataccagcgggcaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactc

SEQ ID NO: 57068 - DNA, 2786 bp, Homo sapiens
actgcaggctggggctccgctccccggcgggagcccgcgcgtggttcccagcgaagtccccgcgcggctgggcccagcgtgagtattctccgcccgctgtcctccccctggaggcggcagcgcccgtttatttgaggcttctaatgtgaggaaaaacacggaatgacaagtgtgggaaagagcaagcactaaattactgtcagaaaaataaacggagtagcacagtgctgctcggtgatttacgggggcaattagtcaccaccccacggcgctgctgaggacagcacggcagcagacaagtcaggcccatgaggaagaagaggctttgcactgctctccagacaacttttcaaacaacaagagaggatatttgagcacattaggttttgtgtcttcattctgggtacctactcttcatattattctaccaacttaatacataaacatatttttagcacaatatgaacctgttctatgtgtgtttaaaagcctccagcagcaacttttttctctcccactgtccaaagttgggttttccccatcccttaaaaaacaaaacaaaaaaacctttcttcactccaaattgtccccctggtgtgtggttttggtctttctcattacttcttgcatcttgctacatgttctgcatttgctcagagccactgggtgctaaggaatttggtctgctgctcctctgggaaagtttggtaagctggtacaaggaggtgatgaacaaggctaaatgaaaatcatacataaacttcccaatatttgtgaacatgttctttaacataccatacatagtttctatgtatatgtaacatagcaaaacaaacttgctaaggtataattaattggtatgcatgccttcataaatattcaccatcagaagaaacctagaatgaaaggttgtgaaagaacccaggaatgagaaagactttattgactaaaggccatgtctatgtaggggcaacaatgaagctgtgggtgagcaaatgaagcttcatcaggagtttagtatccttatgtagcattacctaagaatgctaccatagtaaatttctgaagtactttacctgttacaaagaacgtttgtaatctccttttcttatttgatcttgccctggctttagtcaggaacacctgctcagttagaaatgtattcggtgggtatgtacgcagttggagaatgtgccccaacacacgccgcctttggcctgtatgttggagtcctagagaggcagacaatgttgatgagcttggtaccagcatggtgcgccattcatccggacacaatttctgataaagagggtcacaactgggagaaacctcagattctacttgcttctcttctccacgttattagactttttttcccctcttgaattttataagcacactccttttaaaacaattaattaataacgagcactgggatttgatgtagaattgcgtatttgtaactgcaatggcactggttttcaactaccctgtaacaaggaagcaattctaaccagcaaaagaggcagacgtgtttctgtgcaacatcacaggcgtgtgaaattgttcagatattgagatatcaggagtgatataaattggaaatttaaccaaaaatattttccatcagtgaacaaagccgattttaaagtgcctcttgcatttttcagatctttctctttctttttcccaaagtcacattgtagtttctgataaaggaacacactgggaaaactaagcacatatttaatcaatgaaatttaaggtgtaaaaattctgcatttctgacaaatttaatgttcacttttttcttgatttaaatagagcattctaaaaatattacccctataggggataaatttttatatgcatgttatttttctttacaaagtgtgggctagtaaagagtgaaaaagaccttggctattgtacttatttcttgaaagaaataatagcatcttaatgactggattcaaatctctgcttatcacacaacttccgtacagttcaaagagaggacttggattgaatgaaaacagagagctggggcttcctacattcccctgtgtttgtgttcatacagaatatttatgcaatattctgacttggccataatctgtaattcctgcctattattctcagttgcaactataaattctagattaatggttataattttggtaaggcatacatgaaaagttatatgttcctgcttgaaaggaggatcattaaatattcattattaccactcaaattagttgtcatgctctgtgtaatagttacccgttatcatttcactagtttggattcagcagtaagtgaacagcaatatatagctcatagcgccagaggactttttttgtcggggaacagggagagaaatgattttaaaacccatttgacatatttatgttgacaaattatttaaaggaattactgtgttgtaataaacatgtttgtatgttggaataggattgtggctaaatttgcttctagctgtttaattactcttattatgattgtgaaaaacagtgcttcttcaagtagttccaaggaaaaaaatagaaaatggaaaagttgagctatttcagtcttttgcaggtatctaaccttgccatgaaaaagcacttttcatttttgtaagtagatattgaaatcttgctttttcagcgaagctagattgtataatttattagttttctccacctggtaacacatccttaagaaaaaaattgccaaaggtaaagcatgagatggattttaaaataaatgttgtggatgaacac

SEQ ID NO: 57069 - DNA, 931 bp, Homo sapiens
actgcaggctggggctccgctccccggcgggagcccgcgcgtggttcccagcgaagtccccgcgcggctgggcccagcgtgagtattctccgcccgctgtcctccccctggaggcggcagcgcccgtttatttgaggcttctaatgtgaggaaaaacacggaatgacaagtgtgggaaagagcaagcactaaattactgtcagaaaaataaacggagtagcacagtgctgctcggtgatttacgggggcaattagtcaccaccccacggcgctgctgaggacagcacggcagcagacaagtcaggcccatgaggaagaagaggctttgcactgctctccagacaacttttcaaacaacaagagaggatatttgagcacattaggttttgtgtcttcattctgggtacctactcttcatattattctaccaacttaatacataaacatatttttagcacaaaaaaaaaaaaaaaaaaaaaaaaaaaaaagtgggggggggccggggccccaggagaaagacttttacaagaacccattcgcggtgggggcgcgcgggggcccaaggaggagacagagggaacaacgtgggccaaaagcggtggtccaagaggagaaaccgcgggaccgaggacaagagggcgcggggagatcttctccaccaaatattaaaaaaccgccgggggggaaccgaggacgcgttctgtgagaaaaattctccgaagagggaggggccagaggggggccaatcagggggggcctcatctcaacaccaaggggagggtcccacagggagagagacgccagagaatatcaacaaaaattaaacgccccggggcctgtgtgggagggaagacgttatacaacacgcacaaatatacaacacaggacacacacacgagcagaagatcgacaacacaacaaacacagaagc

SEQ ID NO: 57070 - DNA, 2665 bp, Homo sapiens
gaaggctgctaatcatgcacatgtgcatacgcccaaagcatggcccccgctgactctgcacttctatctgaaactgccatattcctctgcctttgtgtgacaatatcaaaggctcatgctagaatgcaaaggtgttatgacgacagtggcagtgactagatcctatagtcatttttatatttacagttgtcttcatgtaataacaactactgctctccagacaacttttcaaacaacaagagaggatatttgagcacattaggttttgtgtcttcattctgggtacctactcttcatattattctaccaacttaatacataaacatatttttagcacaatatgaacctgttctatgtgtgtttaaaagcctccagcagcaacttttttctctcccactgtccaaagttgggttttccccatcccttaaaaaacaaaacaaaaaaacctttcttcactccaaattgtccccctggtgtgtggttttggtctttctcattacttcttgcatcttgctacatgttctgcatttgctcagagccactgggtgctaaggaatttggtctgctgctcctctgggaaagtttggtaagctggtacaaggaggtgatgaacaaggctaaatgaaaatcatacataaacttcccaatatttgtgaacatgttctttaacataccatacatagtttctatgtatatgtaacatagcaaaacaaacttgctaaggtataattaattggtatgcatgccttcataaatattcaccatcagaagaaacctagaatgaaaggttgtgaaagaacccaggaatgagaaagactttattgactaaaggccatgtctatgtaggggcaacaatgaagctgtgggtgagcaaatgaagcttcatcaggagtttagtatccttatgtagcattacctaagaatgctaccatagtaaatttctgaagtactttacctgttacaaagaacgtttgtaatctccttttcttatttgatcttgccctggctttagtcaggaacacctgctcagttagaaatgtattcggtgggtatgtacgcagttggagaatgtgccccaacacacgccgcctttggcctgtatgttggagtcctagagaggcagacaatgttgatgagcttggtaccagcatggtgcgccattcatccggacacaatttctgataaagagggtcacaactgggagaaacctcagattctacttgcttctcttctccacgttattagactttttttcccctcttgaattttataagcacactccttttaaaacaattaattaataacgagcactgggatttgatgtagaattgcgtatttgtaactgcaatggcactggttttcaactaccctgtaacaaggaagcaattctaaccagcaaaagaggcagacgtgtttctgtgcaacatcacaggcgtgtgaaattgttcagatattgagatatcaggagtgatataaattggaaatttaaccaaaaatattttccatcagtgaacaaagccgattttaaagtgcctcttgcatttttcagatctttctctttctttttcccaaagtcacattgtagtttctgataaaggaacacactgggaaaactaagcacatatttaatcaatgaaatttaaggtgtaaaaattctgcatttctgacaaatttaatgttcacttttttcttgatttaaatagagcattctaaaaatattacccctataggggataaatttttatatgcatgttatttttctttacaaagtgtgggctagtaaagagtgaaaaagaccttggctattgtacttatttcttgaaagaaataatagcatcttaatgactggattcaaatctctgcttatcacacaacttccgtacagttcaaagagaggacttggattgaatgaaaacagagagctggggcttcctacattcccctgtgtttgtgttcatacagaatatttatgcaatattctgacttggccataatctgtaattcctgcctattattctcagttgcaactataaattctagattaatggttataattttggtaaggcatacatgaaaagttatatgttcctgcttgaaaggaggatcattaaatattcattattaccactcaaattagttgtcatgctctgtgtaatagttacccgttatcatttcactagtttggattcagcagtaagtgaacagcaatatatagctcatagcgccagaggactttttttgtcggggaacagggagagaaatgattttaaaacccatttgacatatttatgttgacaaattatttaaaggaattactgtgttgtaataaacatgtttgtatgttggaataggattgtggctaaatttgcttctagctgtttaattactcttattatgattgtgaaaaacagtgcttcttcaagtagttccaaggaaaaaaatagaaaatggaaaagttgagctatttcagtcttttgcaggtatctaaccttgccatgaaaaagcacttttcatttttgtaagtagatattgaaatcttgctttttcagcgaagctagattgtataatttattagttttctccacctggtaacacatccttaagaaaaaaattgccaaaggtaaagcatgagatggattttaaaataaatgttgtggatgaacac

SEQ ID NO: 57071 - DNA, 926 bp, Homo sapiens
agcgggcagacagtgcccgtgccggggcggggaggcgagttctccctgcggccgcggaccctggatggtggcgtcgcccgaagacgcgcctcaccggcctgggtggggttgccttttgccctcgaggctggcctaagcgctggggggccgctggctaaccctgaggtagatactcgggaaatgggtggaatagggaaagggactcagcccttccgcccttttccccagtcgaggcccgcgtcactgccctgtgggtgcagacgcctccagtgtcactcccctggatttcgcttgggcagaagaagagattgtaggccggaccccaacgccgaagccctgaggcttctaatgtgaggaaaaacacggaatgacaagtgtgggaaagagcaagcactaaattactgtcagaaaaataaacggagtagcacagtgctgctcggtgatttacgggggcaattagtcaccaccccacggcgctgctgaggacagcacggcagcagacaagtcaggcccatgaggaagaagaggctttgcactgctctccagacaacttttcaaacaacaagagaggatatttgagcacattaggttttgtgtcttcattctgggtacctactcttcatattattctaccaacttaatacataaacatatttttagcacaatatgaacctgttctatgtgtgtttaaaagcctccagcagcaacttttttctctcccactgtccaaagttgggttttccccatcccttaaaaaacaaaagaaaaaaacctttcttcacttccaaattgtccccctggtgtgtggttttggtctttctcattacttcttgcatcttgctacatgttctgcatttgctcagagccactgggtgctaaggaatttggtctgctgctcctctgggaaagtttggtaagctggtaca

SEQ ID NO: 57072 - DNA, 222 bp, Homo sapiens
gaatatggagtatccatcccctcaagcatttatcctttgtgttacaaacaatccaattatactctttcagttattttaacatgtacaattaaattattattgactctagtcaccttgttgtgctatcaagtactaggtcttattcattctttctaactattccaggccctttttaatcaagaaggctccctagaccaaaattttaaaaagaccaatgctagg

SEQ ID NO: 57073 - DNA, 501 bp, Homo sapiens
gtgtgtctgtgagggtgtttctgaaaaagattagcatttgaatcagtagacccaatgaagatctgccctcagcaatgtgggtgaatatcatccaatccactgagggcttgaacagagcaaaggcagaggaagggagaatcctctctccctcttcttgagatgggacatcattcttcttccctcagacataatatttcctggttttggggccttgagactcagattgggccttccaccagccccaccctcaccctatccccacctccccacttagttctcaggcctcagaagagagtctcatcattggcccccaccagttctcaggacatcagactgggaccaaattacacccctgctttcctggttctccagcttacagaggcatctcctggaacttcttagcctctgtcatcacacaaaccaattcccataataaattccctcttatctctgtacctataatgatacatatgaagatactggttctgtttctctggagaa

SEQ ID NO: 57074 - DNA, 389 bp, Homo sapiens
gccagttcaggttcaaagggaggggaattagactcctaacgttggtgcaatgagtagcatatgtcacagagtgggaaagtattaataatggttatcttttattatctactgcacctaacttacagctgactttgggtgagaaataaattttatgtgttaagccattgagatgtccagtgttttttgttgcctcaccatcagcctagcctaagctgattaataaaatgggaattgtagacaatatagaaaagactttaaaaaaaattactatggttacccttttatgtaatttctcctgttcttttttttttttttttttttttttgagatggagtctctctctgtcatcaggccagagtgcagtggcacaatcttggctcactgcaacc

SEQ ID NO: 57075 - DNA, 194 bp, Homo sapiens
attttattgtagtaagaataatacatagaaataacattaaataaatattctcacaaaaacatacacacatagtacaggtagaacatataactggttgatgctaaataacagatccagataatttttcatttgaattagcagcagggagtcattgaatgctatgcccttagaatggcttgcaggctttcacgagt

SEQ ID NO: 57076 - DNA, 395 bp, Homo sapiens
aataagtgtaataatatcatagatagaaagctattataataatatgacattagatatcatagataaaaagctattattttctgttcctattgtaatcaggatctgagccttagactacttcaatacatgcttcacaccgagaggctgtggaaattaggcttcatgtccaaagaaaaagaagaattggaagaagaagtctctttcccaccagcatcgtagtagctgggatttgatggaacgtgtgttctatctctattaatttgctccagttacttttcagataaatacatttgtgatttggtgctgagagaaggctagaggaccccagagggcaagggccgacagacaggcagacactttctccagagagcaacactcgggttcacaagaaaggg

SEQ ID NO: 57077 - DNA, 306 bp, Homo sapiens
ctgactaatgcgatgctcagaaatgtgagactagaaagaccagagcaaatcaaaatggatttgggtacaaataaggtcaattagaaactgttgtatatgactcttaggctagtcagtcattttttcatgattgacttgaatttcaaagccctagctttcaaggaccagaatctcttcgaaattcatcttacctgctttattccttactcgacacccgcggggcacttgtcctgatgagaatttgtcattagtgtgcattttattgctcaatctctaggacttctaaaatgagactgaaatgttaga

SEQ ID NO: 57078 - DNA, 420 bp, Homo sapiens
gcaatattgggctcactctgaaccagatgctgctgctctaagtgccttgcaactgttaacccactgaaagtgcatgacaaccagatggtcattgattatcctcatttcatggacaggaattgatatgacacctttaactgggttccaaagagtatgaataccaatctctcagtattcacaactgcatatttcatcaactgcaatcacaactgatatccacgacgattctcatttcatggataaggacactgaaacagactgcttatgtaacttgcccaacatgcacagccagcgtggtatctgttctccaaagacggctcccattgaacccaacttcgtggcactggtgtccctgtataaataaatcctcccacactgaccctgggctgcccgagactcactttagctaacagcatcagt

SEQ ID NO: 57079 - DNA, 614 bp, Homo sapiens
tcacctataatgatggttagcataaaaattaaggtttagggtattggctttgaattcataaattccatctgggtgggtttaaaaagtataagttggttaaactggttggaaagagtggaaaattatagttctctgttaagataaattgttctaactaaattagtataagaagcgtttgagcagtcactggaaacatacaatacatcccagttaactttccggtactttttctcttagtgaagtatacgtttgttttatagcagcaagaattagggatgcttctagccttctcagccttctgttcaggctctggggtcatcttgtagtatgcttgttaggtccctaagaagacactgtgtttgcctctctgtttatgcctcaggtaaacccattcaataaacatatagcaatcacatttaaagattctcatcttacttatccaaaagtttcagaaattgtccttttaaagtacaaacatccataaaaaccgagaagatgggccgggtgtggtggttcacgcctataatcccagcactttgggaggccgagacgagcagatcacctgaggtcaggactttgagaccagcctggccaacatggcaaaaccctgtctc

SEQ ID NO: 57080 - DNA, 366 bp, Homo sapiens
tatatatatatttggacaaagagaataagagaattgcaggtagaaatagtctactgtgtgtagacaaatccagaaagttgatttctgttcctcaaacaatttctgaaatatttatgtcagaataaataaaagaattgttattgttggacaatgaaacatacctggaccctttgagtgtgtgaatagtaaaggctgtgataactgaaatgcagctaagcaaaaagggctaattagaagacttttgagacatgatttacctaaatggaaatagtttggttttcaatccttcactgtaataacaattatttgcatctattaagtgtttgtagtcactttgtataataaagttttatggcttgtgattat

SEQ ID NO: 57081 - DNA, 209 bp, Homo sapiens
cagttgccaggtcaattggtgggtgttcaggaattcacatgcagatataaagttttctattctttaaggtgagtaaaggcatgaaaaaatcctagaacaagagtcttcaaggatgataataacactgacccagcccagtaatatttccaacctctcccattccgaggcctaaaatgtctttttctggctttggatggatggtaaacatc

SEQ ID NO: 57082 - DNA, 311 bp, Homo sapiens
cgaattagtgaactgtgcttcaggttcaggaacctggtcttagctccttgcctgctgagattttgagttacaagtagaattctccaaaagcaaaacacgtaaaagtcatttttccactcttttggtcaagcacatgtaagctttcaggaccaggtggtatgccgttgctgaaagtgagacacatgccccagggaaagggtaattttaaaattcttcccataggtcctcatcctgttcctctgctatgtccagcatcctttagtcccagctgcagggcctatatttaaataccctcatgcttatcgctttgt

SEQ ID NO: 57083 - DNA, 310 bp, Homo sapiens
gtaacccatcccatagggttgttctatgtattcttgccaggtggggttggagcaccttgtgagctcagcagcccaacatcgatagtaagggagtcagggtttcttcatcttccctagagttagaactcaattctacagccactgtgtcagggaccactttgagcgcccttggcacctgctggctggaaatcaatttagctgtaatggatctggcccagcttttcctctcttgggtcatctgcactcatagtggttgaagcaagatctaccagatggggacattgagatggtccctttctccttctcattt

SEQ ID NO: 57084 - DNA, 120 bp, Homo sapiens
atgcctggcctacaataatcaacttctacagatggaaaaaagttattctacaccataaacctgtcgacagaatatggtaatgtgaatcctgaagatttttcaagtatttggtgtcagagg

SEQ ID NO: 57085 - DNA, 407 bp, Homo sapiens
aaatatttaagaatgtttcaacttctcatgtagtttacttcaaaagtaacctttataatattagactataagttatgctgcagaagtaattaattgacctgattctattcattaattaagactctccctggtatcaaatgagaagcttaacatactgggcagtataacagtaatcattgtgaaagtgctcactttggctttatgattaacataggaacttaagaactgcttagcttaaaaacttgctagagtatatttaacggggcctgaaagagacctagtatatttaatggggcctgaaagagaccttaatatggtccagtttttttttttttgagacggagttttactcttgttgcccaggcttgagtgcaatgatgcaatctccattcactgcaacctccacc

SEQ ID NO: 57086 - DNA, 230 bp, Homo sapiens
ttacctgaatgaatcctgagtctttgcttctctctctctaatttcaggcctatgtgagtatcagtaagggcgaggaaacatggtagagtgcttgagttccctctcgttttgatatatcctatcgcttttagctctctcttggattagaggaagggtatgaacataattccacattagtttatatgtattatgaggcacagatctctgatacaaattacaaaggcagcagc

SEQ ID NO: 57087 - DNA, 448 bp, Homo sapiens
tcagtggaaataaaatccatatggttagcatcctcttcaattatctttatctgcctaagagaaagagtgctgtcttcactgagctaaaaatgttccaatcctcgttctttgcaactggtctgacattcagcctccttcctctaatagcccccgctctgtttattttacccactatcacttcagctggctaatgctcttccaaaggctagttccaaaaatgtgttacagtcatcctggtctgttcatcccagcagcagcatcactgcactttcagtgaccccctcaccttccctgttgcctttgtctgacttgctaatttcccatcatgccttggaaattgcatggacaagaacttcataaaattcttgataggtttttgttatctagtggcttaaaaaatgtctctcactagtgtctgtagatcaggcagtccagaattgtataaagg

SEQ ID NO: 57088 - DNA, 294 bp, Homo sapiens
ctgactgagattgtgcccgagggacctttctgggagctggaaatgttctatatcttgaccaaggaggtggttacatgggtgtagacatggaataattcattgatcttaggattgtatgattaatttgcaagacccaatgcaaaatgaaaacgaggggtctcttgctaaaaaattcttaggactttcaggatagcaacagcagagcattcaatgaaaagcaggcccttctaagtgtggggccctgcattgttgtacagagcccatacccatgaagctgggcctggttaagctgag

SEQ ID NO: 57089 - DNA, 723 bp, Homo sapiens
ctgatttccacattcaagattctgcaatgttgtgagttgcaatggtgtttgcggtggtggtgaatgtttgttgtttgtggtggtggttaatgtttaatattcacctcagccaccaaaacaggtctgaatttcaacacggtactcagagatccttcactccccacagagcaacagcttttggagtcaggggaagtctgggttccaatcccagctctgtgattttgagctctgaaactttccaaacctgtttccttctctgcctttcagggttgcaggggttaaatggatagcattaatcaccttcctttcacaggctgttagcactcaatcaaacctgcttctcccactcaaagatgtttaagacccaggcaagtcacacccgacagaacctcaacagacagggaataattaccaaggggtaccttccacaccatgtcccctactgccctgaaggagaatgcctctaagcttagcaaaaacaagcttgaatttttgctcacatgaacttttctacaaaagcaataaatcaaagaaaagagtttaggaacagattagagcagactcagatgggctcaggttccattacccgcccccgccccgcagggcgctgctcactgctggactccgaaagcccagctggcttttctcctccaagattctccaccgaccacccccgacaaacacgtcaccaccctggccagcactgagcacagtgggtggaag

SEQ ID NO: 57090 - DNA, 687 bp, Homo sapiens
taatggagtagcacgggcctgtaatccaatatgaccgatgttcttatgagaagaaacacagagtcaggcacactgggaaaatgccgtgtgacaatggaggcagagatgggagtgatccgcctgcgggccaaggaacaccagggattgctggcaacaccagaagctaagagaaaaccatggagcagcttctcccctggagccttgattccagatttctagcatccagaactatgagacaatacatgtctgttgtgtaaagcctcccagcttgtgagactagttacggcaactctagaaaatgcagcagccaatatggtggtaccagctcagattgattctttatgatccccaaatctcccctggatagaagatgcttgtgtttcaattcatcccaccaaaatggaaaatcgttttggttgaggctgctctgctgttgcttggctactgtctctaaactcactatcttctaggaacaaggatgacatgctactcaagacgaaacaaatgactcaacagcaggcagtgtaagtggatttacaagtactgcaggcaagaaatgatacaatatccttactggaaacttgagcaaaggcctgctgtgagacatggtaaaacttttatatcagtcaacctgctgcagtcctttgctctgtcgtgaagcaaataataaagaaggctctgagctct

SEQ ID NO: 57091 - DNA, 860 bp, Homo sapiens
gcgcatgcctgtaatcctagctactttggaggctgaggcaggagaacagtttcaacccaggaggcggaagttgcagtgagccgagaccgccacattgcactccagcttgggcaagaggattgaaactccatcacaaaaataaataaataaataaataaataaataaatataaaagaaatagacaaagcaaatcttaatgcatgaactcaaacaaatgctttcactgccaggctccatctttgcaaaactgaacctaggacaatgtgaacgtttctaactagcaattctggaggacagatcagggaggcagcgtgagcttgcttttctgcaatttaattgactggtcagtaaagtcagtgtttgcaggcattttcaatgttctatagtgggcttcagtgcctgtggcaggccaggtttgcaatagcaaccagaacagtttctactaaccctttactataattttgatgaatgcataagttaacgttaaagaaatggagaaactggtgcctgagtatcacggatggaatgtgaaaacaaacccactgagaccccgtctgggttttctcagaccctaaaatctgatcgaataatgatagcgttcgtacacattcacctcggcctgtcttaagattcaaaaactttccaagactctagggaaatctttccagacgctagacccgagttaaagattagatgttgattgaatgaaacactcctgcttgtaggtgcaatcccacatggagcttaagatatatataagcactagaaaaaaaaacttgtaactttgagttgatctggtgatttacctggcgcttctccctgtaagtggctgcagaaataaacttccttctttcccagtc

SEQ ID NO: 57092 - DNA, 284 bp, Homo sapiens
ttcccactgtcatggaaacccgagtgagccaccaggttgacccctttcctcttgcctgtgtgacccaggcctccaccctgcagaagccagggggtgagaggtttgaagagggcagatgggaatgccatccaccacagcctcaccctgactcgatgtgtgacctgggacagccttctaaggccggggctgcagggggctgtcttctgaatacgtggaccactcacggctcagcctgggatcgcagaaggccagacctcagttcctgagacagaacctctgacctc

SEQ ID NO: 57093 - DNA, 185 bp, Homo sapiens
tgtctgtgagatgctgagaaattcactcaatctctctgctcctttcctgtaaaatgagggacttaagtaatccctaagatttcttccagccccagccatgtgagagcagggatttgcagggttttttaatcaattgtattgcaacaaaatttacatagaataaatgcacccatttcaagtccaca

SEQ ID NO: 57094 - DNA, 2411 bp, Homo sapiens
gggacacatgatgctgtgaacctcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagccacctaggggaggaggccgtgtgaagacagaggcagagattggagtgacgcatctccaagccaaggaattccaaggactgtaagccaccagtagaagctttgaagaggcaaggaaggattccctccaatagccttcaagtgtgaccctgctgacacctgcagaattcggacttctatcctccaaaaccgtgagggaataaatttcctttgttttaagccac

SEQ ID NO: 57095 - DNA, 2677 bp, Homo sapiens
gggacacatgatgctgtgaacctcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcagagacaaaaatatcttaaatcagataaataatgtggccaagtgctcacagttaattcatggcagagttaagatttgaacccaggcctgtctgattccaaagcgtgtgatctgcacaaggccatctcagaagccaaccagatgcagccacctgatcttggacttcccagcctccagaattaataaataagccttttctacagtagtgaagaggataaaaaagaggaactgcactgatgcaacaaatacctcaagagaagtcaattaatgactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagccacctaggggaggaggccgtgtgaagacagaggcagagattggagtgacgcatctccaagccaaggaattccaaggactgtaagccaccagtagaagctttgaagaggcaaggaaggattccctccaatagccttcaagtgtgaccctgctgacacctgcagaattcggacttctatcctccaaaaccgtgagggaataaatttcctttgttttaagccac

SEQ ID NO: 57096 - DNA, 2566 bp, Homo sapiens
gggacacatgatgctgtgaacctcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcagcacaaggccatctcagaagccaaccagatgcagccacctgatcttggacttcccagcctccagaattaataaataagccttttctacagtagtgaagaggataaaaaagaggaactgcactgatgcaacaaatacctcaagagaagtcaattaatgactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagccacctaggggaggaggccgtgtgaagacagaggcagagattggagtgacgcatctccaagccaaggaattccaaggactgtaagccaccagtagaagctttgaagaggcaaggaaggattccctccaatagccttcaagtgtgaccctgctgacacctgcagaattcggacttctatcctccaaaaccgtgagggaataaatttcctttgttttaagccac

SEQ ID NO: 57097 - DNA, 452 bp, Homo sapiens
tgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggtgatatctctagggtttcaggatacactcatttatccagtatggactgggctcttatatgacagacactgttcttgggatacactaggaacaagtagataaatatccctgcctttgaagagtgtgagtagtgaatgaatatgagaatgaaaatgttgagataccgtgggttctttccactccaaggcttcccgttttagtcttccttctccaacaatctaaagaggactaccagcaatgttaggctgtctctctaagcacttactttaggacccaacaaaggcttaatcattgctggaga

SEQ ID NO: 57098 - DNA, 568 bp, Homo sapiens
gtggggacacatgatgctgtgaacctcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggtaaatgaactatcagttaggtgatgtttgatttgctgattattaggaaatagtgtgggttgttttctcttgttaattaaaacagcctgaaagaaattatttgggtgattagtttgagattgaacatctccttttagtgatttggagggttccaagctggtaaggactaggccttttaaaagccggacatgaaaacaagctgaattctttaaaggctgggaaaatactgctgtagagttacccctagttgggaaacttttgtagaagaaatggttttatttataaaatggtatcattttctttctcatttacctaaggtttttccttccaggatatctgcaatcaagttactatatgtctgg

SEQ ID NO: 57099 - DNA, 1074 bp, Homo sapiens
gtgatggagacaagatttagtgtatagctctgctacctgcctggtgttcctttgagtttctttatccttagatttgacagctgagaaatctaggtggatttcatattcgtaatcattgattaacatgcacatttgggtttgcacatttttgtttatcatacatttttctccgttttctattaaagaacatgctctaggggaactattaatagcccaccagtcgggtaggcagcattcaatccttctatgccttctttcgccacctgttgaggtctttcttctgaaacaaagaagaaatagacaaatcagacttgccctcttggaaatgtggtccagatttctctactcccaagctccaaaaaaggtatacattggatgggctagatcaactcctcctgagagccataaatccgccaagagttgttttccatgtaagggtgtggtacaatggggaacacctgatgttggaggaaagcaggaggactttagagtggagttgcattctaatctctctgccgcttcaactatgtgacctggggcaaatgatataaactctatgagcctctttccttatctttaaaatgaagagaagtaatacctaccttgtagggctgttgtgaggattaaatgaagtaatgcatacagtgcctaacaaagtatttaacatcatattttttaaaagctcatgaaatattagtttttcttccttcccctctttctattttctctcctgttcccttttctctccctcctctgccctctccttccttcagatgttagtctaaaacagcaccttggatctaagcagcacctttgagaaagaaaagactgcttcaagaatgtctagttgcacctcctttccgtatgtggcctaaatgcctaggttggatcaatagtttaatttttttattgaactgtttaatattgactatggacttacattcacttttactgttttctgtatatttacttttgcttgaagtgttttaatattgactatttacctctgctcatttttattgattttctgtattttttcaatgaaaattataataaaaattatttttgttaaat

SEQ ID NO: 57100 - DNA, 436 bp, Homo sapiens
agaaacatgcctttgtgcccaaagtttcattttctccctccttcctatattagaattatgcagacaattagaattccctcattatgggatggcgctgaggcccctgctttaaaataatgaaacaaaactttcagattgtgtaatcattcttggttttcctgtttccccatttttaaatgaagaaactgtagttaagagagtggctgcttttaagtaagctaaaaaaccatgtcgatacagttgtgatgtgattttgattattaccttcaagagatagttaagtgggccaggtgcagtggctcacgcctgtaatcccagcactttgggaggctgaggcggtcggatcacgaggtcaagagatcgagaccatcctggccaacatggtgaaaccctgtctctactaaaaatacaaaaaaattagctggacgtggtggcg

SEQ ID NO: 57101 - DNA, 273 bp, Homo sapiens
ggaggtggggaaaggttcatacacaaagatcagcaatcaaaaatggcatcatattcctgaaaagtagcagtcgaatatggaaggtgatgttgcaattctttcaaaatcctagagggaaggccgtgtgtggtgactcacacctgtaatcccagctactcaggaggctgaggcaggagaatcacctgaacccgggaggcagaggttgcagtgagccaagatgacaccatcacactccagcctgggtgacagagcaagactctgtcaaaaaaaaaa

SEQ ID NO: 57102 - DNA, 329 bp, Homo sapiens
cgtacaggatcagtttttaaaatattactcatgcattttattaaattttctgataagtattagaatctttgaaatcttttcaagataaaaattatattattaagcagaatttaaaatcaatgtaaaataaaattccttaaagagagaagacataattaaataaaatccactaattaaacctcatttagtcaaagcaaagagagaagttcctagcaataataatctaaaaaggaaacaagatttacttacggattacaagcaaatatagaaaaatgacattagtaatatctaagttttcaaagtttattttcaacataaaatgtagagat

SEQ ID NO: 57103 - DNA, 356 bp, Homo sapiens
aagatataagtatttaatctgcaaagacgtggatttgaaaattcagctgccaaatgtaaagaacagattcctagattattattaataatatctctataaatattatatttatcaataatgggtactattcaactttaaaggacacctatggctcagttaggccagggaataaagatacttggataaaagtagtatttataaaatgaagaaaggggcccttctgattcactgtacataaaatgaaacactctaaagtctctagggagaattagagtttctgtctggcacaaaatgaagtcgccctcttgttagtagatataggatacatttaatcaccaagatataaaaggaaattt

SEQ ID NO: 57104 - DNA, 414 bp, Homo sapiens
ctaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatggagggggactggaagtttggggaagcgagacggctacggcaccctcagccttcctggaccaacag

SEQ ID NO: 57105 - DNA, 421 bp, Homo sapiens
ctaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggtcttcagtgttccgacaaccagcatcactgcactgcagaagacagtgcagtatggtttctgttgggtcgtctggaccccgaaccctcaactgattcagtcacccaaacagta

SEQ ID NO: 57106 - DNA, 11967 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57107 - DNA, 11913 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcatataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57108 - DNA, 11690 bp, Homo sapiens
ctgaaaactggagagtgtgagagcgggaggagcccccgaccacacaaacccagcctggggaggaacctactagtggctgcaccctcttttttaatagcaccaattgtgtttcccaagatgatgtagagaatttcagtgctgtgtaccacgtcggaggcagaaattcctctgctgtcccaggagcaggcagggcagtttttatctggaaaagctaaaggtctcctcttttgtttgtgtttttgtgcctgcaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57109 - DNA, 11747 bp, Homo sapiens
aaagaatgagctcggtaccagcaggggtggcgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57110 - DNA, 11691 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57111 - DNA, 10790 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcacccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57112 - DNA, 11646 bp, Homo sapiens
  misc_feature (11621)..(11621): n is a, c, g, or t
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttaaggcgctcaaacggaggggaaagggctcttcctttggggcccaaggcaggaaggttacagggctttacacgtggaaattattgggctcacgaaaaggaggaaaaacctctgggtgggggtttattgtancacaaggttttatgtaaaatacgct

SEQ ID NO: 57113 - DNA, 11200 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcatttttagcccgcaccgcattttaccctctagagtcagctatg

SEQ ID NO: 57114 - DNA, 9934 bp, Homo sapiens
  misc_feature (173)..(173): n is a, c, g, or t
atggggaggaacccgtatgtgtgagcgcctccaagcacagccccactgaaggatgaggaaagtgccaaggcggaggctgatgcatacatcagggagaagagggagtctgtggccagtggggatgaccgagccgaagaagacatggatgaggccattgagaaaggagaggctgnacaatctaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57115 - DNA, 8016 bp, Homo sapiens
gtcactcaggagacaccggactacttctgcctctgcagagactttaatctcattgggcgtcagagagaagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57116 - DNA, 3981 bp, Homo sapiens
agttcccttacccgtacgcccaaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57117 - DNA, 2129 bp, Homo sapiens
ctctaacctcccagaagaataccagtagacgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57118 - DNA, 1810 bp, Homo sapiens
tcccagtggcaattcaatggaatccccgaatggaatcctccagactctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57119 - DNA, 1622 bp, Homo sapiens
  misc_feature (16)..(16): n is a, c, g, or t
  misc_feature (23)..(25): n is a, c, g, or t
  misc_feature (28)..(29): n is a, c, g, or t
gaactagtctcgagtntcccccnnnccnntttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57120 - DNA, 7016 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaaccc

SEQ ID NO: 57121 - DNA, 1175 bp, Homo sapiens
tattacaccatacaactactttatttattagttctgcctgacctgtaatgtaatctgcatgatgcgctggctgttttctgattcagactacatatttcagattggatctacttgttgtattttttttttctcctgcaacctgaaggccaggcagagagggttcattgaaatctaggatttgttagattgtattttaatcagtttcacagcataccctccttctcccaagcctattgcccaatctcagaatgagatcaaaataaactgaaattgtccttactcactttcacaaagttgctagttagaagcaaaatgtccaatccatcctgtaggaagaaagtccattataatggactttcttcaaaacaccccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57122 - DNA, 3806 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacacatccgtactgcccgggtacc

SEQ ID NO: 57123 - DNA, 2500 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaacaaaaaaaaaaaaaaaaaaaaaaaaaaaaaaaaaaaaaaacaaaaaaaaaaaaaacgaaaaaaaaaaaga

SEQ ID NO: 57124 - DNA, 1641 bp, Homo sapiens
  misc_feature (1641)..(1641): n is a, c, g, or t
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcaaaccaatatggcgcatgcgtacctacgtatcaaacctgcacgttgtgcacatgtaccctagaacttaaagtattcatttn

SEQ ID NO: 57125 - DNA, 238 bp, Homo sapiens
ccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttttttttttttttgctatgggatttaatgggaaaaatatgtaaaaactgtcac

SEQ ID NO: 57126 - DNA, 585 bp, Homo sapiens
aaagaatgagctcggtaccagcaggggtggcgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagtactaagcaccacgccacccctgctggtaccgagctcgattcta

SEQ ID NO: 57127 - DNA, 12083 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagttaaaaaaaaaaattcacttgccgacgtttacaacgtcgtgactgggccctggcgtacccacttaatcgccttgagacatcccctttcgcagctgcgttaccgcccgaccgtcgcctt

SEQ ID NO: 57128 - DNA, 11989 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagttaaaaaaacgaaaaaaaaaaaga

SEQ ID NO: 57129 - DNA, 11724 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57130 - DNA, 11872 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcatggtgtctgtgtgtggggtgtggagggagtataattcctgagtggggggggtggtgtctcacccccactcatgtgttgtgccagggggcgtgagtgtgctctacacacggggtttttt

SEQ ID NO: 57131 - DNA, 9920 bp, Homo sapiens
gcccagtctcctggccgagaacctgcatcttcaattcatgatgagactttacctggaggctcagagagcgaggccaccgcttctgatgaggagaatcgagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 57132 - DNA, 10944 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattaccatctcaaccctggcctgtgcatgctttctcataagtaccacatatgtattttctaggatttgagagggagagagtctcc

SEQ ID NO: 57133 - DNA, 7264 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcccgcaattcgacctcaggaatcagctctggccaagattc

SEQ ID NO: 57134 - DNA, 3107 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgttaagaaagaaacaccgccaaaggaagtcaagaaggaagttaagaaggaagagaagaaggaagtgaaaaaggaagaaaaggaaccc

SEQ ID NO: 57135 - DNA, 1945 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgggtaggagtaggatccgtctgagcacctccct

SEQ ID NO: 57136 - DNA, 600 bp, Homo sapiens
aaagaatgagctcggtaccagcaggggtggcgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaacaccacgccacccttaagctgtctgaaccctgcagtgtcttcccagtcacgc

SEQ ID NO: 57137 - DNA, 897 bp, Homo sapiens
  misc_feature (391)..(391): n is a, c, g, or t
  misc_feature (428)..(428): n is a, c, g, or t
  misc_feature (431)..(431): n is a, c, g, or t
  misc_feature (437)..(437): n is a, c, g, or t
  misc_feature (468)..(468): n is a, c, g, or t
  misc_feature (474)..(474): n is a, c, g, or t
  misc_feature (483)..(483): n is a, c, g, or t
  misc_feature (504)..(504): n is a, c, g, or t
  misc_feature (523)..(523): n is a, c, g, or t
  misc_feature (526)..(526): n is a, c, g, or t
  misc_feature (530)..(530): n is a, c, g, or t
  misc_feature (534)..(534): n is a, c, g, or t
  misc_feature (538)..(538): n is a, c, g, or t
  misc_feature (541)..(541): n is a, c, g, or t
  misc_feature (552)..(553): n is a, c, g, or t
  misc_feature (585)..(585): n is a, c, g, or t
  misc_feature (590)..(590): n is a, c, g, or t
  misc_feature (595)..(595): n is a, c, g, or t
  misc_feature (597)..(597): n is a, c, g, or t
  misc_feature (600)..(600): n is a, c, g, or t
  misc_feature (606)..(606): n is a, c, g, or t
  misc_feature (609)..(609): n is a, c, g, or t
  misc_feature (622)..(622): n is a, c, g, or t
  misc_feature (641)..(641): n is a, c, g, or t
  misc_feature (663)..(664): n is a, c, g, or t
  misc_feature (675)..(675): n is a, c, g, or t
  misc_feature (680)..(680): n is a, c, g, or t
  misc_feature (682)..(685): n is a, c, g, or t
  misc_feature (691)..(692): n is a, c, g, or t
  misc_feature (694)..(694): n is a, c, g, or t
  misc_feature (696)..(696): n is a, c, g, or t
  misc_feature (709)..(709): n is a, c, g, or t
  misc_feature (722)..(722): n is a, c, g, or t
  misc_feature (733)..(733): n is a, c, g, or t
  misc_feature (738)..(738): n is a, c, g, or t
  misc_feature (748)..(749): n is a, c, g, or t
  misc_feature (752)..(752): n is a, c, g, or t
  misc_feature (758)..(758): n is a, c, g, or t
  misc_feature (763)..(763): n is a, c, g, or t
  misc_feature (777)..(777): n is a, c, g, or t
  misc_feature (804)..(804): n is a, c, g, or t
  misc_feature (817)..(818): n is a, c, g, or t
  misc_feature (826)..(826): n is a, c, g, or t
  misc_feature (832)..(832): n is a, c, g, or t
  misc_feature (873)..(873): n is a, c, g, or t
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggcctaacgtaaatgaagaaaatggggaataaaacagattcgaagagatggaggtnaagccttgtgaatttccccaaagaagtccctattgantgntaagantgaaaacaagacaagccgggtgcaaggtgtntgaaanatgtgaaanaaatgatgtgcccacggcaancctgaaaagaaagaactcntgntccnaccnaccnacnccccccctacnnacgaaggaaggaaccccccaagaatgccttgnttgancgccncnccntgcctnaanaaccatgtgcctnaaggaaacataccgctaanaagtttgctgccaacccgctcnnacccggcctgnacgancnnnnacctcnnananaagggtgccttgnacacaaaagaaanaggaaagatgncgctnagctccaaannaancctccntgcangcctgatccccccnagcgcctttgagaagaaaagaagggcnagccctctctgcnnaaaagcanggaaanagctccaaaagcctgtccttttgggtgagagagggctggantgcagatagaacacggggttatca

SEQ ID NO: 57138 - DNA, 315 bp, Homo sapiens
ctactctggaggctaaggcgagagtatcacttgagcccaggagctcaaggctgatcatgccaccacccctggccagaaaaaaaagcttttaaataaagtaattgtcagcttaggcaacatagcaagaccctgtctctacaaaaaaaaaatttaagttagccaggcatggtggcactgacctgtaatcccagctactcaggaggctgagacatgagaatcgcttgaacccaggaggtggagattgcactgagctgagatcctgccactgggctccagcctgggtgacagaatgagactctgtctttaaaaaaaaaa

SEQ ID NO: 57139 - DNA, 2981 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcgcttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccg

SEQ ID NO: 57140 - DNA, 4169 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcgcttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactaaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaa

SEQ ID NO: 57141 - DNA, 3992 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcgcttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactaaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccaaagtgctgggagtataggtggtgagccatgggcctggctagtgagtgcactgaccgacgacgacttggggaactgacgacc

SEQ ID NO: 57142 - DNA, 2792 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcgcttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccg

SEQ ID NO: 57143 - DNA, 2707 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccg

SEQ ID NO: 57144 - DNA, 3852 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcgcttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaa

SEQ ID NO: 57145 - DNA, 3352 bp, Homo sapiens
  misc_feature (2741)..(2741): n is a, c, g, or t
  misc_feature (2843)..(2844): n is a, c, g, or t
  misc_feature (2850)..(2850): n is a, c, g, or t
  misc_feature (2855)..(2855): n is a, c, g, or t
  misc_feature (2858)..(2858): n is a, c, g, or t
  misc_feature (2861)..(2861): n is a, c, g, or t
  misc_feature (2882)..(2882): n is a, c, g, or t
  misc_feature (2892)..(2892): n is a, c, g, or t
  misc_feature (2913)..(2913): n is a, c, g, or t
  misc_feature (2918)..(2918): n is a, c, g, or t
  misc_feature (2926)..(2928): n is a, c, g, or t
  misc_feature (2930)..(2930): n is a, c, g, or t
  misc_feature (2936)..(2936): n is a, c, g, or t
  misc_feature (2948)..(2948): n is a, c, g, or t
  misc_feature (2963)..(2963): n is a, c, g, or t
  misc_feature (2970)..(2970): n is a, c, g, or t
  misc_feature (3009)..(3009): n is a, c, g, or t
  misc_feature (3026)..(3026): n is a, c, g, or t
  misc_feature (3061)..(3061): n is a, c, g, or t
  misc_feature (3067)..(3067): n is a, c, g, or t
  misc_feature (3108)..(3108): n is a, c, g, or t
  misc_feature (3115)..(3115): n is a, c, g, or t
  misc_feature (3168)..(3168): n is a, c, g, or t
  misc_feature (3349)..(3349): n is a, c, g, or t
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcgcttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccactgcacccggcctctgtttactttttgtacancggtgatagcagctcttaagtatacccattccactggatcataaaccagtacactgcgcagtgagatagtggtatatgcttatttgtaagagaacaacaaannaaatanaaaanacnagntctagggctaagttcactatnaatctaattnaatttgtgactaaacactctnaatanacaaaaannnantctttnatatgacatgtngcaaaagtcacctgnagctatnactatagttgagtgttcttaatagcaaaaataacaaaanaaaaaaaaaaagttctnatttaggctatttgatgataaagggatgtacctgnaaaaanaaatatatatttataaaggacctaattaatttttacaaaangattttnttttgtatagtactaatctgcaaatgagcttccctagctggaatggaggtttnagagatagtatagtatagtggttaagaacaccgattctgctagtctgcttaggttcaaatcctggttctactacttactagctgggtgactgtgggtaagatatttaacctctctacttccgtactctgtaaagggataataacagtatctacattttggggtggtaatgattaaatgagntac

SEQ ID NO: 57146 - DNA, 3936 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcgcttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacagggttttgtcacattggccaggctggtctcaaactcctgacctcaggtgatccacccacctcagcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactaaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaa

SEQ ID NO: 57147 - DNA, 1626 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccg

SEQ ID NO: 57148 - DNA, 1696 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccg

SEQ ID NO: 57149 - DNA, 1507 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccg

SEQ ID NO: 57150 - DNA, 1596 bp, Homo sapiens
tcagggttatggagcccttttctttcccagcttctcttctgccaattttgaatgatatagctgcaccaacaatatcccgcctcctctaattacatatgatgttctctgttcaaaagtaattggcagtgattggcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactaaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaa

SEQ ID NO: 57151 - DNA, 1381 bp, Homo sapiens
ggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctcctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcgaagtcctgacctcaggtgatccacccgctcggctccaggtgctgggattacggtgttgagcacaccctggcagaaaaaagttttaataaaggattgccgcttgcatagcagacccgttctcccagacaattatttcccggtgtggcctgagtataaccagtcttcgggagggggct

SEQ ID NO: 57152 - DNA, 1197 bp, Homo sapiens
tagagtatcccggtcatcttgctacacatcaggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactaaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaa

SEQ ID NO: 57153 - DNA, 235 bp, Homo sapiens
atgatgacgattactttctgtgtctaccttccaatactaagtttgtggcattggctagtaatgagaaatgggcatacaacaattcaggtaagaaactctagccatgtataaaacggcctatgcagtacagcatccatcatgattactttcactgcacagacaattgccatttgtctggctttttaagcatttgttcaacagatatttactgagcactttctatgtgccagacatg

SEQ ID NO: 57154 - DNA, 299 bp, Homo sapiens
aactacatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaagggttggctcgggaccccgggcgagggtgtgggggagccagggccgggtgaggacgtccggcg

SEQ ID NO: 57155 - DNA, 797 bp, Homo sapiens
cggttttctgctgaggctgagccgtttgctccagcctccgactaaactcattaagttgggagatttttttcaattggacgggtgtttttaaagtctcgtctttccagccccaaacaaggtgtaacaacgcactcttccttctaaggaatgagatgagagacaaggatcactccagacatctcctacctacggtttggggttttttttcttaaaggcgaggcttgcattcctcagcagctatgtacaaagctccctgaaaccttgtctctctaaagttagtgtgcagggttttccaaggctgagagagcctaatacatggggaagcacttccttgaggtggaagatctctcccttcacctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttggtatgtttacttacagtattttttctctctctctttcctttctcacttttctgcttgtgctgtgtggggttggggatgacttggggcttttcaaaatatcggtttgctaacgtgtatgaaatgccgaggactgtggtttaaggggttcggggaaggggggatcagagtcaattcaatgcattgccatattttattacatgtgtgtggtaggagagatggt

SEQ ID NO: 57156 - DNA, 4114 bp, Homo sapiens
  misc_feature (912)..(912): n is a, c, g, or t
  misc_feature (931)..(931): n is a, c, g, or t
cgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccacgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcggcgccggcctccgccccggcctgcctggctccctgggcngcccgcacccggcgcctcngatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggg

SEQ ID NO: 57157 - DNA, 3567 bp, Homo sapiens
  misc_feature (912)..(912): n is a, c, g, or t
  misc_feature (931)..(931): n is a, c, g, or t
  misc_feature (3056)..(3056): n is a, c, g, or t
  misc_feature (3058)..(3058): n is a, c, g, or t
  misc_feature (3076)..(3078): n is a, c, g, or t
  misc_feature (3082)..(3082): n is a, c, g, or t
  misc_feature (3084)..(3084): n is a, c, g, or t
  misc_feature (3093)..(3093): n is a, c, g, or t
  misc_feature (3099)..(3099): n is a, c, g, or t
  misc_feature (3111)..(3111): n is a, c, g, or t
  misc_feature (3114)..(3114): n is a, c, g, or t
  misc_feature (3116)..(3116): n is a, c, g, or t
  misc_feature (3132)..(3132): n is a, c, g, or t
  misc_feature (3140)..(3140): n is a, c, g, or t
  misc_feature (3150)..(3150): n is a, c, g, or t
  misc_feature (3152)..(3152): n is a, c, g, or t
  misc_feature (3567)..(3567): n is a, c, g, or t
cgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccacgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcggcgccggcctccgccccggcctgcctggctccctgggcngcccgcacccggcgcctcngatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacacagaatgcattaaaaaaaaaaaaaaactccggggngntgggccaaaacactgtgnnnattnanaattggggntataanaaggggaaatanggncnttttcctttttggggngaaaattnttgggaaaanantttgggctaacaaggtggctttaggggagaattgggggagacacttcacgcagatgggggagaacaggaaaggtcttttttgttcccaaatttattaaatgggcccgggggtatagggtcccttagaaaagtgtccttttgagagactttcgggggtcccaaacccaggttaaatccggggggtcataaaaaaaaggtccggagagaaaactcgtgggggttcctgaaaaacagcggtgttcccttaacaatttttgtgtcttcggcaagattcaacaggggctgtccggggaaaatcacccttgggcgaggacttacaactctctagagagggcactccaaaggttggtgggaaacggcttacaaggtgggtggacccaattttgagggggaagtgcaggcctctattgaaggn

SEQ ID NO: 57158 - DNA, 2573 bp, Homo sapiens
cggttttctgctgaggctgagccgtttgctccagcctccgactaaactcattaagttgggagatttttttcaattggacgggtgtttttaaagtctcgtctttccagccccaaacaaggtgtaacaacgcactcttccttctaaggaatgagatgagagacaaggatcactccagacatctcctacctacggtttggggttttttttcttaaaggcgaggcttgcattcctcagcagctatgtacaaagctccctgaaaccttgtctctctaaagttagtgtgcagggttttccaaggctgagagagcctaatacatggggaagcacttccttgaggtggaagatctctcccttcacctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttgcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctga

SEQ ID NO: 57159 - DNA, 2649 bp, Homo sapiens
ctgatactgtcgttaacagtttaatttatgactatttgcaaaatgtggaggcctgtgtggagaatgcaaatcgcctcacaaagagataaaggttcctgttatctgattcagagggagacacacagttccgaggatgccgagggaaggagtcctgtgcaaacagatcttttagttcctgtccacagacacctctacattctgtagacatgcagagtcctagatatacatatgaggaggttgcatgtgtgttctggttcttggggtggaggtggtggtggagattttcgaatatctgttttaatgactcacaatatgcatatgttaaccccagtcttgtatggggagccctgaaaggtcaggtcacaacctgaaccgcctttaccaagaagcttctcatttcaaaggcacttactgtattttcacgtatcaaaaaagaaaagtgttttcctgaagataacagggaggggggatgcttctcggagggacctgggttttaaaaaataaaggggggtaggagaaaaagggagagagaagaaaaagggggaaaagaaacagctcaaatgaacagagagatcacggtttgcatggctgcccttcaataggctaaactgacaagatcagttttaaagggccacttaaatcagtttcaaagactggagaaaaatgagtcgccctctttggggggaatctgaggctggatcgtggacgccattactcgggactgggccaggttgtccacccccaacccccaacccctatataattataagccaaactattatttacagaggaggaggggagagagtgctggtagttttggtttcttctgtttactgacttgggccagacagacccaatgcacttttgcttgggcctctcaatgacccaggctaaggactcgggcagtgaaagcctgtagcacactgagctatgttttattttaaagcaaacacttcctcaggaccatctcttgctctttcttcccccaccccgcctcccccccttaagttttcagtacatagacatttgctccaactccggttggggcagtttgacagagctctgtgcacacacctcatgtgacccaattcaaacctcttaatctgatgactgaattcttcttcttcttcttcttcttctttttcttcttcttcttcttctgtttttaaactttcttccagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctga

SEQ ID NO: 57160 - DNA, 2021 bp, Homo sapiens
ggagtgtctcctttcctccccgcagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctga

SEQ ID NO: 57161 - DNA, 4024 bp, Homo sapiens
  misc_feature (912)..(912): n is a, c, g, or t
  misc_feature (931)..(931): n is a, c, g, or t
cgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccacgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcggcgccggcctccgccccggcctgcctggctccctgggcngcccgcacccggcgcctcngatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctga

SEQ ID NO: 57162 - DNA, 3393 bp, Homo sapiens
cggttttctgctgaggctgagccgtttgctccagcctccgactaaactcattaagttgggagatttttttcaattggacgggtgtttttaaagtctcgtctttccagccccaaacaaggtgtaacaacgcactcttccttctaaggaatgagatgagagacaaggatcactccagacatctcctacctacggtttggggttttttttcttaaaggcgaggcttgcattcctcagcagctatgtacaaagctccctgaaaccttgtctctctaaagttagtgtgcagggttttccaaggctgagagagcctaatacatggggaagcacttccttgaggtggaagatctctcccttcacctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttggtatgtttacttacagtattttttctctctctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctga

SEQ ID NO: 57163 - DNA, 3040 bp, Homo sapiens
  misc_feature (912)..(912): n is a, c, g, or t
  misc_feature (931)..(931): n is a, c, g, or t
cgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccacgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcggcgccggcctccgccccggcctgcctggctccctgggcngcccgcacccggcgcctcngatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaggaacctcaagccgaattcctacagcccgagggatccacagttc

SEQ ID NO: 57164 - DNA, 3459 bp, Homo sapiens
  misc_feature (912)..(912): n is a, c, g, or t
  misc_feature (931)..(931): n is a, c, g, or t
cgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccacgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcggcgccggcctccgccccggcctgcctggctccctgggcngcccgcacccggcgcctcngatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgttgtggcttacgtaattctgacttttgaaatctcactgctcgtgaacaaaatctacactgcaactttatttcttgcaccgtgcctggacttcagccacatcctgcactacattcgcttacaggtgaagacagtgacaagacgaacgacaccattccaaaggtgacacgtgtgtaatactcttctataatgactattgtatcatatcccctctaccggacaaaattctcttggatcctctgcaccacaagagggaacatttctaccaacagcacaggaaagttccctgccaaaacacttaagatactagtaaaaccttacgatagtgctaatgtctcatcgcatgacagcacagaccacgcgagtgacctcggaacaactcactgtggaacactgtctaacaaggcaatcagcgcgcacacgggcccaacagcacaatagatggacaagaggaaacacacgactcagcaccacagaggacacccaacccgaagtgaatcaccaccgagaccaaccagatggtgccacgcacacgccctcaaacacgcctctaggccacccaacctgaccacggccacaaagcgcaccacgcagaaacaacacgcccacagaagctcgagcgcgacacagccccacaaccagaactcacgcacgacaactaccaccgacaaccaaaacactcgcgaccgagcatcacaacgacagcaacatacacaagcga

SEQ ID NO: 57165 - DNA, 638 bp, Homo sapiens
gcaccgacttcagtgtgcatgttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatagtgaaatatgagttggcgaggaagatcaacatataggcctaggccaagaagaagtttacagcctcctgagctgattggggctatgcttgaacccactgatgaagagcctaaagaagagaaaccacccactaaaagtcggaatcctacacctgatcagaagagagaagatgatcagggtgcagctgagattcaagtgcctgacctggaagccgatctccaggagctatgtcagacaaagactggggatggatgtgaaggtggtactgatgtcaaggggaagattctaccaaaagcagagcactttaaaatgccagaagcaggtgaagggaaatcacaggtttaaaggaagataagctgaaacaacacaaactgtttttatattagatattttactttaaaatatcttaataaagttttaagcttttctccaaa

SEQ ID NO: 57166 - DNA, 1156 bp, Homo sapiens
ctgaaagtgaatacgttcttaaactctaatattttcggaatatagatgaaatggttgataagctaggaatgcatgcattattaaatatatcccagtagtacctgaatatctattcatcacaaagactgtgcatgaacttgtgaaatttgctagttgtcccttgataatatttacttttagaaataaatatttagttattctagatgtcttcctctacatctccatttccctttccgtttcttttttttcgtgccatactgttcatgatatatacctctttcatattttgatatcaataatgataatgatagattaaaagtaatgcgatcatataattaattatacaaaggggaattttttcaagtgtaaaaagagatatttgtattaacatcaggactataggtgaaaactggggacagatgtttaccataccttaatatctacagaagggtaaactaacccaaagcaacatttttgcactttggcacaatagaggaaaaaacaaatgcaatactgtcctttctattcaccacgcatatgcagcttctaatgtgacattaactcttttcttaaaagatagttttcatactatttccagggagcctatttgacatccagaccatagtttcaagccaaaatattaaattgtacattttttataaattcctttgtttcttagtttttttgtgtgtatttgttatatttttagtaaaattatacacaatttttgctttatacattaaatccctttttaagagtttcacttgatttaatgtgttctgacctcggactgccttttgggtttcccttgtagcacctagaaagcagggtgtgtttaaaaaatattaataatgtatatgtttggaagtttatctcccaaagtctcccacagaggtctaattgaatgtaagccagagggtgactcttgggtttatggtcttagtccactgtacgaaacaaaaactttggtgtcatttgcatatcttaatgtgatctaaatacagttctgctagtaatgttccacctgttatgtttctattacaggtgaagggaaatcacaggtttaaaggaagataagctgaaacaacacaaactgtttttatattagatattttactttaaaatatcttaataaagttttaagcttttctccaaa

SEQ ID NO: 57167 - DNA, 652 bp, Homo sapiens
aggctagtagaggctgggggtgtgaatcggcagagggttctggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatagtgaaatatgagttggcgaggaagatcaacatataggcctaggccaagaagaagtttacagcctcctgagctgattggggctatgcttgaacccactgatgaagagcctaaagaagagaaaccacccactaaaagtcggaatcctacacctgatcagaagagagaagatgatcagggtgcagctgagattcaagtgcctgacctggaagccgatctccaggagctatgtcagacaaagactggggatggatgtgaaggtggtactgatgtcaaggggaagattctaccaaaagcagagcactttaaaatgccagaagcaggtgaagggaaatcacaggtttaaaggaagataagctgaaacaacacaaactgtttttatattagatattttactttaaaatatcttaataaagttttaagcttttctccaaa

SEQ ID NO: 57168 - DNA, 1031 bp, Homo sapiens
  misc_feature (684)..(684): n is a, c, g, or t
  misc_feature (693)..(693): n is a, c, g, or t
  misc_feature (697)..(697): n is a, c, g, or t
  misc_feature (706)..(707): n is a, c, g, or t
  misc_feature (710)..(710): n is a, c, g, or t
  misc_feature (713)..(713): n is a, c, g, or t
  misc_feature (717)..(717): n is a, c, g, or t
  misc_feature (719)..(720): n is a, c, g, or t
  misc_feature (729)..(730): n is a, c, g, or t
  misc_feature (737)..(737): n is a, c, g, or t
  misc_feature (744)..(745): n is a, c, g, or t
  misc_feature (749)..(749): n is a, c, g, or t
  misc_feature (759)..(759): n is a, c, g, or t
  misc_feature (788)..(788): n is a, c, g, or t
  misc_feature (792)..(795): n is a, c, g, or t
  misc_feature (798)..(798): n is a, c, g, or t
  misc_feature (803)..(803): n is a, c, g, or t
gcaccgacttcagtgtgcatgttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatagtgaaatatgagttggcgaggaagatcaacatataggcctaggccaagaagaagtttacagcctcctgagctgattggggctatgcttgaacccactgatgaagagcctaaagaagagaaaccacccactaaaagtcggaatcctacacctgatcagaagagagaagatgatcagggtgcagctgagattcaagtgcctgacctggaagccgatctccaggagctatgtcagacaaagactggggatggatgtgaaggtggtactgatgtcaaggggaagattctaccaaaagcagagcactttaaaatgccagaagcaggtgaagggaaatcacaggtttaaaggaagataagctgaaacaacacaaactgtttttatattagatattttactttaaaatatcttaataaagttttaagcttttctccaaaaaaaaaaaaaaaaaaaaaaaaaacgggggttttttggggggggggnaaaaggggnttgnagggggggnnagnggntccngnncccattttnngtcacgnggggaanntggnggccccccanaagaggggggataaattgaaaaggcgggntacnnnnttnggacngctcgccaccggggcacaaacaccccagtcgggcgtattgaaccaggaacacaagaccataaagcacgcagacaaccacgaacaccagggaacagcgggaacacacaatgaccgagcggtcacgcgacacagagtcgtacactcggccaacgacagcaacactaaacgggacacaaaccgcatgtctcaacacgagacgacagcatgacacaaacagcggtcgaagcc

SEQ ID NO: 57169 - DNA, 471 bp, Homo sapiens
aggagaaatcgcgaccaagaatttcatatttggcaaagctaagcttcataagagaaggagaaataagatccttttaagaccaagcaaatgctaagagtatttgttaccaccagacttgctttaaaagatgtcttgaagggagtgctagatatagaaaggaaagcctgtgttacccaacccatcacaaaaacacatttaagaacgtagactagtaatgctataaagcagcaacacaatcaagtctgtgtgataaccagctaacaacatgatgatgaaatcagacctgcacataccaatattaaccttgaatgcaaagcagctgaaagccctaattaaaaggcacagaatgacagcttggataaagaagcaagatcgaactgtatcctctctacaggactcatctcacatgcaatgacactcataggctataagtaaagggatggagaaaaattgcccaagcaaatggaaaac

SEQ ID NO: 57170 - DNA, 691 bp, Homo sapiens
cactgcattctccctcccgcaagcacacagatcctctcttctctccatgtagtcactacttggggaaggggaatgggtggtatcagcaattcaagactgatttcttttccatcttcagcgcccctttccttgatatgatgttaaaaccagaacaagaaacagatcgaggaagaggcagagtaacaacagccgggaagaagatacagttttgggccaagggaaaagagcttcattagcatatttgtcaagcagatgtgaaatgaggcagaaaactactagaacaattggagaaatctagaatatgaagttccagcacaaacttagatggcttctaactatgtgaaggtttgaacagcagcttctgacatagaaaataaccacagcaaaaagaagcactaacaagtgacagatgtggttgactcatctccttctcccttcgactctctaatgagcaattaaatagcctgaaacagaacaatcaagaggtctggcaaatccacacactagatgactgccttttcacttaactgtgtcctcatatggaagagaggagaaaagaggagaggaggggagaggcaagttctcttgtgtttcttcttacaaagcacaaatgccattatgagggccccaccctcaggacctcatctaatcctaatttcctcccaaaattaaatctcaaatgtcatcacat

SEQ ID NO: 57171 - DNA, 356 bp, Homo sapiens
ataattagagcttgatcttgttgataattatgaatacctgtaaaatgttctctaaaagtccctgatttctcttattttctcaaattaaggataagcttagaattcggttttatagactatatctgcaaggcgatataaaaaggatttgttgacaaatagttccttaaagaatattcccaaagaataaactttggaaggccaaggtgggcggatcacttgagctcaggagttccagaccagcctgggcaacactggaaaccatgcccggctaatttttgtatttttagtagagacggggtttccccatgttggccaggctggtctcaaactcctgacctcaggtgatccacctgcgt

SEQ ID NO: 57172 - DNA, 485 bp, Homo sapiens
ttcccgggtcgactactattactaaattcgcggccgcgtcggcaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaaaaaagtcgacgcggccgcgaat

SEQ ID NO: 57173 - DNA, 4440 bp, Homo sapiens
ggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57174 - DNA, 4462 bp, Homo sapiens
ggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaaaaaagtcgacgcggccgcgaat

SEQ ID NO: 57175 - DNA, 4454 bp, Homo sapiens
  misc_feature (4271)..(4271): n is a, c, g, or t
ggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacactnttttatgttcaacaatgttgaagtttgttcaacatgcgagggtgtggtaatgggggtgaaaagaaagggaataagattgcgccataagaatctagaggatgggtaaaaggattaaaagagagaaaaagggggaaaatcggggagaaggacacctataaggaaatgagataaagggaaatgaaa

SEQ ID NO: 57176 - DNA, 4094 bp, Homo sapiens
ggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaaggcggcagctcgcgatctagaac

SEQ ID NO: 57177 - DNA, 4898 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57178 - DNA, 5085 bp, Homo sapiens
ccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57179 - DNA, 4416 bp, Homo sapiens
ggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57180 - DNA, 4813 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57181 - DNA, 4700 bp, Homo sapiens
gggaaagagagcgccaggtgcttagcaggatttgcctcaaagggcactgcaaaaattgaacagaggaatcccaaggaagctgcctgaatttgcctgtatactctcgttctgcgacttataaaggaccagacaaatcaaattagtggttttgagacagggtctcactatgttgcccagactggtctggaactcctgagctcaagcaagcttctcacctcagcctcccaaagtgctgggattataggcttcagccaccacgcccaaccagccaggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57182 - DNA, 4865 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57183 - DNA, 4648 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggacagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57184 - DNA, 4161 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57185 - DNA, 3820 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgccagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57186 - DNA, 3258 bp, Homo sapiens
tttttttacagtatacaggaggatgtgcataggttaaatgcaaatacgccattttctctcagggactcgagcatctgaggattttggtatccacggaggtcctagagccaatcacctgtgaggatactgaggggcaactgtatttcacctttccctcagccttccaggcctctcactttcacaaggtggcatcactgagtttgaggatgcagctccaccttacctcttcagtggctcttctcccacttgcttacaataattgctgtttgcccgcccctctgcctttctctcccttgcttttgtgtctttgtattcccgtcttctgggagaggcttgttgaatgaatggatgataggtacatacacgtgttcaggaaggctcctttttgtctcttctcctcaggggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57187 - DNA, 3251 bp, Homo sapiens
gcctttagccaggggaggctcagccagcaggataaaatttcagggcagatttacgggaagttgccggtgttgggagtaaaaatctggtttggtgagtttaagaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57188 - DNA, 3537 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttgtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57189 - DNA, 3654 bp, Homo sapiens
ccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57190 - DNA, 3211 bp, Homo sapiens
  misc_feature (16)..(16): n is a, c, g, or t
cagcagctccagcccntaaaatgattgaagatggcaaaatccacacagtggagcacatgatcagccccattgctgtgcagccagacccagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggacagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57191 - DNA, 2998 bp, Homo sapiens
gccgaatttggaaatccctaccgtcaacccagttgccattaaacttggtacagtagccatccctgccagggcctaggggttcctacctcgggggatattctgctggccgtggtatatatagccgatatcatgaagggaaaggaggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57192 - DNA, 4500 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaatctcttttcctatcttttcctccccccctcctcagtcctctttccccctcccttctcttctccttccccttttctcactttcttctctctcttctccttcttccatctctctttctcaccctcctctttcaacttatttgcaaaaaagaagaagaagaggaagaaacactcttattccttccgctatcccctatccttcgcactgtccga

SEQ ID NO: 57193 - DNA, 3738 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattagga

SEQ ID NO: 57194 - DNA, 3600 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattgggtcatgttctgtggggatcctctaggtcacctgcgaa

SEQ ID NO: 57195 - DNA, 1400 bp, Homo sapiens
ggtctcagaggaagggcctctcgggcagcacctcctgttggaagtggctgaacaggggctcgcgtcgtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57196 - DNA, 3679 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgtgcctttcgtacaagagggatcct

SEQ ID NO: 57197 - DNA, 3102 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagatgatcggtaccggctgattattttttttc

SEQ ID NO: 57198 - DNA, 3091 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatcttacctcttggggcttaaggaccttgggctaacgacctgggtac

SEQ ID NO: 57199 - DNA, 2305 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggccgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggagaattccttgaacccaggaggcggaggttacagtgagtcgagatcatgcctttgcactccagcctgggcaacaacagcaaaactccatctt

SEQ ID NO: 57200 - DNA, 1707 bp, Homo sapiens
ctggtactgctcccgagtacgggatgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaggagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcagcataagaggccgagggcggggtgggaagtgcctgctgtttataatgttggatttgcaaatacagtttattttacagaaat

SEQ ID NO: 57201 - DNA, 549 bp, Homo sapiens
ccttcaaagaagatatcaagtggccaaaaagcacatgaaaagatactcaatatcacaagtcattagggaaacacgaatcaaaactacaatgagatactactttacacccaagcaggatggctatcaagaaaagaaagaaagaaagaaagaaagaaagaaagaaagaaagaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaa

SEQ ID NO: 57202 - DNA, 602 bp, Homo sapiens
cggacgagaagatgttgtaggtgacttcctagctgtgttaagttgctcctgggctgtgaatggtgttaatttctgaagtgggcggctccaaaaacttaacaaggaaaggtaaggtggtttttggtagtccttctaactattgtcccttaatcttacatttgggtcccaatttttgaagtgtatatttttttcttattcttctctctttagcccttatccctcatgctatcactcatcttctgtctcttggtatatttagtgggaaataaagggtttataaaacggttttaaaagggtcaacctctgggaaggcagataatcatatacagtcagtcccatcgtgtttcctgtagtgatgaatcttttcccataaaagaaactgatttttttttttcactcttgaaaatacatgattggaccgcccagaagcacaggtgactttagactcagattattacagtgagactgaggaagcgtcctggacaggaggcatctcatttaagtgttaaccaaggcagaggggggtcttcctgcagtaatttacgtctgaaagtaacactcggtagaggtgtagttgtttcaaattaaaaattcagcctgta

SEQ ID NO: 57203 - DNA, 1946 bp, Homo sapiens
acatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgtttggctatctcattgatttttcctttgactgttagctcaagaattgaaacacctcaactaaaacatttaaagatcctttaaaagcacttgtagactagaacttgatttattttttcccatctctcttcttttccccttctcttttctttctttttgtaaatgtttcaactaacttttattgaagttgaagtcacactttatccaactgcgtaatatttaagcttcaactaaaaacaagctttcagtcatgattagagggt

SEQ ID NO: 57204 - DNA, 394 bp, Homo sapiens
gccgggtcactcagggaagaggctgtgctgaacacggcaagcagcatccccggcctgacccacagatgcagcagcacccgcgtccttgcttttccacccaagctgtgacaaccaaaaatgcctctagacactggcaaggtcccctgaaggtggggtgagcttgccgccactgagcggccctgctttgaggccagggtcacagtggtaaggtccccactgtggtggaaggcttggtttgatcctggcttggccatctgcacctgcctgacaacaactcactggatcctaccatggtgggcaccatccttggcactgaggccatgccctctccaccggatgagccacccaagctctgggcgtcgctgtcctctttcataaaattggagaaactgta

SEQ ID NO: 57205 - DNA, 741 bp, Homo sapiens
ccgaccgccattgcacaacgcggaggactagcctggggtcacagggatgccgcggctcctccgcttgtccctgctgtggcttggactcctgctggttcggttttctcgtgaactgagcgacatcagcagtgccaggaagctgtgcggcaggtacttggtgaaagaaatagaaaaactctgcggccatgccaactggagccagttccgtttcgaggaggaaacccctttctcacggttgattgcacaggcctcggagaaggtcgaagcctacagcccataccagttcgaaagcccgcaaaccgcttccccggcccggggaagaggcacaaacccagtgtctacttcttgggaagaagcagtaaacagttgggaaatgcagtcactacctgagtataaggataaaaagggatattcaccccttggtaagacaagagaattttcttcatcacataatatcaatgtatatattcatgagaatgcaaaatttcagaagaaacgtagaaacaaaattaaaaccttaagcaatttgttttgggggcatcatccccaaagaaaacgcagaggatattcagaaaagtgttgtcttacaggatgtacaaaagaagaacttagcattgcatgtcttccatatattgattttaaaaggctaaaggaaaaaagatcatcacttgtaactaagatatactaaccatcttagaattttttctaacctaataaaagcttaatacatttatttaaaaa

SEQ ID NO: 57206 - DNA, 803 bp, Homo sapiens
ccgaccgccattgcacaacgcggaggactagcctggggtcacagggatgccgcggctcctccgcttgtccctgctgtggcttggactcctgctggttcggttttctcgtgaactgagcgacatcagcagtgccaggaagctgtgcggcaggtacttggtgaaagaaatagaaaaactctgcggccatgccaactggagccagttccgtttcgaggaggaaacccctttctcacggttgattgcacaggcctcggagaaggtcgaagcctacagcccataccagttcgaaagcccgcaaaccgcttccccggcccggggaagaggcacaaacccagtgtctacttcttgggaagaagcagtaaacagttgggaaatgcagtcactacctgagtataaggataaaaagggatattcaccccttggtctgctggagtttgctggaggcccactccagatgctgtttgcctgggtatcaccagcagaggctgcagaacagcaaagattgctgcctgttccttcctctggaagcttcatcccagaggggcacccactagatgccagccagagctttcctgtatgagtgacataagggaattctaaattgatacaccatcaggattcaccctcaagattcaacttcaacatttttcaaagtccttcaataagaaggtaaaactcagtttcaagtttctttgtcaacaacaacctttactcctattaccaagaatttctattcaacaaactgcaaagcagttataaaagtaataaaggtaaaaaaaagtggtaccatgagattcacactg

SEQ ID NO: 57207 - DNA, 181 bp, Homo sapiens
aggcccactccagatgctgtttgcctgggtatcaccagcagaggctgcagaacagcaaagattgctgcctgttccttcctctggaagcttcatcccagaggggcacccactagatgccagccagagctttcctgtatgagtgacataaggtaactttttaaaaagattatgtgtaaactat

SEQ ID NO: 57208 - DNA, 2609 bp, Homo sapiens
ctgccctggtgcacacagatggcacatggcagagcccaagccctctccatgagatctgcagcgtttgtccacacggcagggcaaattaccttgtagagtcagcatggaggtttgcaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgctacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgaaaaaaaaag

SEQ ID NO: 57209 - DNA, 1329 bp, Homo sapiens
ctgccctggtgcacacagatggcacatggcagagcccaagccctctccatgagatctgcagcgtttgtccacacggcagggcaaattaccttgtagagtcagcatggaggtttgcaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgctacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggttacaccgcacgaaaagttggcaatcctctctctcggtggctgctgtgggagcagctaacctcacagcacccgaagggatgtcatcgggaccccagctcggtttccagcatcagctgatgccagcaagaagccagccaggcctggggcttggcagcccagggactttaccatccaccatccacagggctgttgccctggacaggtcattgatatctgactcacagccaattcatggatgacgtgaatccaaaaatcagaggcccacgtggatttagacatggaaatgcctcaccagcttccatgagccagtctctgtgcggcagacttgaactgcacgggggctgataggaagcagggtgggcgctgggatgtgactgtgcccttgccagtgtttccagtctcccagctcgggttctgtggttgtctaagcctgggggtgctctgccgggtctgtggcgacccggctgccttttcagcctaatcaccagagaagccacagaaagagctggaccacttagaggggcagtctggccacagccacttggaagaacaggctgattttgtacagatgtgtcattttctcctgacttttaaactgtaaacattatataataccctagaaaattttgaaaatagatataaaccatcaataacactggcaacctaacacttttacctaagagctacccattttgatttatctgatgcgcagttttcattgctggaatcataaagac

SEQ ID NO: 57210 - DNA, 267 bp, Homo sapiens
aggagggtgaagtggttctgacagagccatgttctcagcccaggagcagttcagacagcatttctggagtgcatcttctgtgcctagcactctttgatgcctgctgggagggacagagcattgcaaagtcagacgaacaccaggccaggcatgcagggacagtactagatccaggtctcctgcctcctggtcatgcaaccatttacaactgtgtgaatattttacaaggatggccctcactgagaattcagtggactagtagtagta

SEQ ID NO: 57211 - DNA, 400 bp, Homo sapiens
aggagggtgaagtggttctgacagagccatgttctcagcccaggagcagttcagacagcatttctggagtgcatcttctgtgcctagcactctttgatgcctgctgggagggacagagcattgcaaagtcagacgaacaccaggccaggcatgcagggacagtactagatccaggtctcctgcctcctggtcatgcaaccatttacaactgtgtgaatattttacaaggatggccagagaggttgggcttgatggcctctgaggtccacggcgtggccaagttctcatgccactttctcaccctcctatgaccctgaccgcacactgctcctataggatcctaacatgcccatgttgatatagctcccctcactgagaattcagtggactagtagtagta

SEQ ID NO: 57212 - DNA, 2456 bp, Homo sapiens
ctgccctggtgcacacagatggcacatggcagagcccaagccctctccatgagatctgcagcgtttgtccacacggcagggcaaattaccttgtagagtcagcatggaggtttgcaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgctacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctagttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgaaaaaaaaag

SEQ ID NO: 57213 - DNA, 2485 bp, Homo sapiens
ctgccctggtgcacacagatggcacatggcagagcccaagccctctccatgagatctgcagcgtttgtccacacggcagggcaaattaccttgtagagtcagcatggaggtttgcaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgctacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgaaaaaaaaag

SEQ ID NO: 57214 - DNA, 1816 bp, Homo sapiens
ggcactgactccatcacggtgtgaggagcagcagctcagggccgactgggaccagaaatgctagatttttatttcttggggacaggcagtgcaggagggaggctgtgtgggaatactccgaggagcagggtcgctctgagtttcacctgttcctgccgttttccaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgaaaaaaaaag

SEQ ID NO: 57215 - DNA, 902 bp, Homo sapiens
gtgaggatggagggtaggggccaccggccgtggcctcccaaagcttgcatggcttttcccacaggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgaaaaaaaaag

SEQ ID NO: 57216 - DNA, 1978 bp, Homo sapiens
  misc_feature (1776)..(1776): n is a, c, g, or t
  misc_feature (1779)..(1779): n is a, c, g, or t
  misc_feature (1791)..(1791): n is a, c, g, or t
  misc_feature (1803)..(1803): n is a, c, g, or t
  misc_feature (1810)..(1810): n is a, c, g, or t
  misc_feature (1829)..(1829): n is a, c, g, or t
  misc_feature (1846)..(1846): n is a, c, g, or t
  misc_feature (1854)..(1854): n is a, c, g, or t
  misc_feature (1858)..(1859): n is a, c, g, or t
  misc_feature (1865)..(1865): n is a, c, g, or t
  misc_feature (1872)..(1872): n is a, c, g, or t
  misc_feature (1875)..(1875): n is a, c, g, or t
  misc_feature (1877)..(1877): n is a, c, g, or t
  misc_feature (1883)..(1883): n is a, c, g, or t
  misc_feature (1886)..(1886): n is a, c, g, or t
  misc_feature (1892)..(1892): n is a, c, g, or t
  misc_feature (1896)..(1896): n is a, c, g, or t
  misc_feature (1898)..(1898): n is a, c, g, or t
  misc_feature (1904)..(1904): n is a, c, g, or t
  misc_feature (1908)..(1908): n is a, c, g, or t
  misc_feature (1916)..(1916): n is a, c, g, or t
  misc_feature (1919)..(1920): n is a, c, g, or t
  misc_feature (1926)..(1927): n is a, c, g, or t
  misc_feature (1929)..(1929): n is a, c, g, or t
  misc_feature (1931)..(1932): n is a, c, g, or t
  misc_feature (1953)..(1953): n is a, c, g, or t
  misc_feature (1959)..(1959): n is a, c, g, or t
ctgccctggtgcacacagatggcacatggcagagcccaagccctctccatgagatctgcagcgtttgtccacacggcagggcaaattaccttgtagagtcagcatggaggtttgcaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgctacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagaggggcangtncccatcaagggnccgcccggagcntcacttngggtctcccatcaagcgangtgtggcggtggggccnctgaggangtgnncttggngggtgcntancngggtgngcncccggnttcncnctgggngggncgttgggnccnnctcccnngntnnggggttccttgggcgccgggncccttntggggggggtaccccggag

SEQ ID NO: 57217 - DNA, 1987 bp, Homo sapiens
ctgccctggtgcacacagatggcacatggcagagcccaagccctctccatgagatctgcagcgtttgtccacacggcagggcaaattaccttgtagagtcagcatggaggtttgcaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgctacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggtaagcacagcccctaaccacaagggaaacctagggccttatctttcccagctcctcaaagccgcctttaacttctcccagcacagccctgagggaagacacctgagggctatacggtttctacagctctagatcagcatttccttcatttacccaaatgtgttcagcagaatggtagtgccctgagacctcccatggaggaacagctttaggata

SEQ ID NO: 57218 - DNA, 491 bp, Homo sapiens
gttgctgttctgggcttctaggagaggagtttattcggctgaggagcaacacagtcacctttctactccatccaagaaacagctccttccccagcagcccacaggggctgtgcgggggacacagtgtgggctcggtcttggcgtggaggcccccaggctgtccttcaccatgtgcctgttccctcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggtaagcacagcccctaaccacaagggaaacctagggccttatctttcccagctcctcaaagccgcctttaacttctcccagcacagccctgagggaagacacctgagggctatacggtttctacagctctagatcagcatttccttcatttac

SEQ ID NO: 57219 - DNA, 526 bp, Homo sapiens
ggctgtttagagaccgggcagccaggcaacgcacgaggctggagaagtggtctgggactgtgggcactgctgtcccttgcctgggcccactgtgccccgcgggacgctcagggccccccacccaccgaggaccccagcccctcacccccgcttgcggtctcctctgccgcagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcaggggg

SEQ ID NO: 57220 - DNA, 639 bp, Homo sapiens
ccatctacattgtcaccgagtacatggccagaggtggtgccccccgcagagccgcatcctcagagcgaggcgggagggccgggcttagcaggaggaggagggtccgctgcggtgggttcaccaggccagggggtcctgcagatctagggcatggcacggtgtggggacagggagggatggagggagggggagggacagagggagggtgagaaacaggagggtgaagtggttctgacagagccatgttctcagcccaggagcagttcagacagcatttctggagtgcatcttctgtgcctagcactctttgatgcctgctgggagggacagagcattgcaaagtcagacgaacaccaggccaggcatgcagggacagtactagatccaggtctcctgcctcctggtcatgcaaccatttacaactgtgtgaatattttacaaggatggccagagaggttgggcttgatggcctctgaggtccacggcgtggccaagttctcatgccactttctcaccctcctatgaccctgaccgcacactgctcctataggatcctaacatgcccatgttgatatagctccctaacaactgtcaccaaggggcccccggtcggaggctgtgctgggggtgcctctagcc

SEQ ID NO: 57221 - DNA, 307 bp, Homo sapiens
tggaagaatgaaggccaagtgatattcttgagtacttaatgtttacatttaagaaaatcgtaatctgggccaggagcaggcagtggctcacacctgtaatcccagcactttggtaggctcaggtgatctgcccacctcagcctccaaagtgctggaattacaggtgtgagtcactgtgcccagccgcagtcacctcttgaaaaaccaaatccaaccacaatgttaaccacaacattattcctatccctgaaataaatataatgaaactatttgggaaacaaggtttgaaattattgagccatgaact

SEQ ID NO: 57222 - DNA, 339 bp, Homo sapiens
agatttaatctactttttcctggctccctcccattactgggagagctgggtcttaaacccagataccctcttctccagttccaggccctttgtcctgttaagaaacttctccgtttgacgtgtcttgaggctaattcttctacagtaatatgaggctttgatccagacagctccagagaaactacgctcaaagtggagggttttcttaattgtagagaaactcacattacattaccttgtttgtgagatgtgttctgttgtattcagaaaggttcagaagaaagtcggctctggtcctgtctagaaatctttgatgcaggagccatttagctggagggg

SEQ ID NO: 57223 - DNA, 434 bp, Homo sapiens
ccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaaga

SEQ ID NO: 57224 - DNA, 538 bp, Homo sapiens
acattgctaaatgtcccctaggggacccctacactgaagttggctggagctctggggatcagggaggacatctgcaagcgtgcttatgagttgtaagctctaagaggggagggacattgcacagggcaggtcaggcacattgtaagtgctcttaaaacattacagttgagaagaatttcagagtaacatttatagccaagaaagatattcttcccccaacttgggcattcccttgatgttaaattgtcctgtgcgtcaaaaccctaaagaactgcagggaagcctataaccccaaaggaaggcagagaaaggtcctgggggacaggttgtggggtgagttaacttattccagccaaggtgaaggagttgccccgggcttcactctgagacttggagcctagtgtgctaagctcccagttcccaaagtgaccattcccacgctgaatgtcattactgcctcatcagcagcttgtcagctgtaatttctaatcccaagccgggtctctcttcccaggaccaaagtcataaagatgtttgc

SEQ ID NO: 57225 - DNA, 361 bp, Homo sapiens
agggagggtaaaacaaatccctctccaatgctttgtagaaggggattagaatcactgtggaattcggtattggctaataaagtataaacgctaaagatcaatgcctgagtgcacagttgtccttcaagccattgtacttctgctttccaagaatagaagactactttttaaccaagaattaaaaataaactcataatttaaacacctctttcatgccaaatggaaatcttagtgttgaataatcaggctcacctgaatacaaagttgtcctgaaaatgctgacaatcacaaaaaaggttctagaagctttttcaaaaaacaagttcagatggttccaactgagttactattgagtttaaag

SEQ ID NO: 57226 - DNA, 326 bp, Homo sapiens
gtaaagcattgtcactagtgctggaaatagccatcccaaacctaagtgacatcctcacctgccagcacaattaacccttcaattatttacttagacaaccatgtgttaaaggcaagttaaatatgttaactacttacagttctattcagctcttgcacgatgtctctgggaaatctctgttcttgggatagcttactgatggtgaagttaccattggctccaactctataaactcttccctcaacacaaagatcgtcttctcttggctactatatttactgagactaagtggcctgcttcatcttctaccaaatgttcaataagca

SEQ ID NO: 57227 - DNA, 518 bp, Homo sapiens
cagagtgagactccatctcaaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaa

SEQ ID NO: 57228 - DNA, 346 bp, Homo sapiens
agtggaattgttgttatagagtgtgagctttttcagctttaccagatattgctaaattgctgtctgaagcaaatgtagcagttcacactgctgtctagaattttctcatatccttattagattttgaattgtcagaccctgtgatttttactcttacgatggctgtgatatgcttttttgttttaatttgtacttcccttatttatggggataaatatatttccatgtttaataagcatttggatttgttcttctgtcaacaacatatataaatctttgtcaccaaatcagcttttttgaggtatgacttacatgtaataaaatgtgccaattttgagtgtaccat

SEQ ID NO: 57229 - DNA, 568 bp, Homo sapiens
ttttctgaggtggagtctcgctctgacggccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttctctcttgttgcccaggctggagtgcaatggtgcaaactcgg

SEQ ID NO: 57230 - DNA, 730 bp, Homo sapiens
gaagaaaagaaaagcaaataaaggaaaacacacccagagcagtgagagaagtctgtatacaacgacccatttgtgcagtagaggctgtgcaggcaggtaccgggaacagggctccaccttttagaaggtggtcctctggcgtgagccaccgcgcccggccagaagaaatttctaataacactcaaggacggccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttctctcttgttgcccaggctggagtgcaatggtgcaaactcgg

SEQ ID NO: 57231 - DNA, 546 bp, Homo sapiens
agccttggctaatctgatgagtgtgccctagaatttggttcagaagctgttgacatgaagaatcagagatcgccaaggactcaattctaccacggtcacacctagagaccaacgctcagtgatctggtagtgtcattctgactcccggatcagaaaagatgcctgtacccactgcaaaagcagagcagagtccctctacctgggtcaagcccaaaccatcagtactcccagaaccaacaaaatgtcctgagagaaaaatagccagcaatcatcagatcacctcgaaattattctctctttctctctctggaattttagttcacttagtcttcgttgctttcacagctctcaggtgcttctgaaaatgacttttttaatattttccatttgttcaggtaagagtattggcctatcacatcctgccccaaagcagaagtctttctgtgtataatttttgatctttacaattcaggtcttccaaaagtatgtaacataactaatacatgtttgttgaaatgaatgaataaataaattattaatgctaaa

SEQ ID NO: 57232 - DNA, 253 bp, Homo sapiens
aaaaatgtgtgccctttggcaacactgcatgacacatgaaagggccaacatgattcaaactcttagctatggaagcctgggaggatggtaggtttggatggtctatggccttctgatgcctctatcactccaacacaagtgcccttagttgttcagtgtcctataaaaaaggatggaaaactaggaccactttcaaggggcttatgcaaatacataaagtgcctgaattaaactctgaagcagtaacagggta

SEQ ID NO: 57233 - DNA, 322 bp, Homo sapiens
tttacagtattttctgaaaggcagcatcaaattctgaatgggcatcactgattcatttacacatctgttaaaattttattgagcacatactatgtgtggtgtaatgcactactttccaatgataaggaatttagataagcaaaatgtgcttcaggtcgtcaggccacggtgattataatttggagagactgtaggtaggcaactcattacaaatgaagcagaatgaaactatcactaaattgagtaggcaggaatagcttactctggcagaaggcacctgagaatcctaattgagggaagacttttaggttttaagtaagca

SEQ ID NO: 57234 - DNA, 480 bp, Homo sapiens
ttgggagcagagggactctggccagtgtctctgctttttcactgtgtgaccccgggcagatacgtcaacgtctctggacttcagtcccctgaagcaaaatcacaataatgagaatccgctcccaggcctgccatgaacgcgaagtagcccataaacagcagctctgtgcgtgtgtggacgagaaagtgaacgcgagagctctgcagacctcaatctcacgcccgcaaggatttgccaatggctgcttagaaagctgtgcttaccctgggcctcaatgcagctgatcacttggggcagtggcacagcaggaacagggagggaagcccttatccccagcagccacaagagtggaggcaaaacttcatacccaccttagcttcccaattcccctggctgtcctcccagcctagtttttaaatatctgaatcttaagcgtgcacctaggagtaatcttaataaatcgcatccctccctgaaggt

SEQ ID NO: 57235 - DNA, 612 bp, Homo sapiens
ctcgtgcctgaactcctgacctagtgttccacctgccttggcctcccaaagtgctgggattacaggcgtgagccaccatgctggccatcatttctgtttttaatatctgcagtgcctcaaagtgtttacattttatcactctgtatccatcatccttaatgcttaaaagctttagaagtatgttatacatacttctgctgtagcatttattttcatatttgtagtcctagctttgctgctaaaccatgagctcttggaatgccagaggcaaagttatcttgcacgtcattgtattcttaagcacctaacagtatgtctggatgccttttttctgattgatattacttcttggccaggatagagaaatggttaagttctcacataaaattgaagagttttctcagttttgaaaagcatattgggtagaaaagaagaatttctttggaagcattaaggacactttgtattgtcattttcttagacagacttatggttcagtcaccatgagttatcatttctgtatgcctactcatcttaagattgtcataccttaatcctaataagagaacagctcaacaagtaggtaggtgagattgttactggccagtattg

SEQ ID NO: 57236 - DNA, 844 bp, Homo sapiens
gctgtctctccccgcatctgcctatccggtgaaggaagagaggcagctgcaggagctgctgttctggaggcagacaggaagctggtgagggagctagggaactcctgaggcctgcctcttcctgtaggaagcagcactaagatagagatttgggaccaagggcaccaactgcactctcacccatttcctttagggctgtctgcctcattctcagaggtccagtctggccctgggactgacaaagtcaggggcattccagagtctgagccttgaagctaaggttcactgctttgggttctgtccagcatagcttcagactcatgctgagaaaacataaccaacaattactgagtgcttactctggcctggcactgttctgagttcctgctgctcagagtgtgggctgtggaccagcagcagcagcacccggggacttgttagacatgcagcatctcagaccccaactgctgaatcagaagctgcattttaacaagacccaggtaatttgtatgacacgaaagcttgagaagcactgttcttcatacttagatctattaactcagttaatcctttaacaatcttctcagctgagtccttttattatcatccgcacttcctatacaaaaaaaacctgagtcatagagaagtcaggtaacttgtcttaggtcacacagctagtaattttgataggtagaattcaaacctaaaaaaactgcctctggagcctgcatagttagccactatgatgctgaccttgtaaacagcatggagaacagcttctttatccatccaaatggcagagggcttaggacactagtgaggaataaagtcaacttcaccaaga

SEQ ID NO: 57237 - DNA, 500 bp, Homo sapiens
ttataacttccttaattactcctgcagacaacatcactattttagaatgtaagattggcctttcaagatgtcttttcaagtttttgcatttccgataaataacggctcgacccacctgccaacaagttctgtagctccacctaggaaccagctcagtgtaagaggacagctttggctccctatgagttcatctcccacccaaccagtcagcacttcccattccccagcccctacccaccaaactatccttaaaaaaccctagtctcaaggccaggtgtggtggctcatgcctgtaatcccagcactttgggaggctgaggcgggtggatcacttgaggtcaggagttcgagaccagcctgcccaacatggtgaaaccctgtctctactaaaaacacaaaaaaattagcttggtgtggtggtggggattccaggtgtctgccaccacatccagcctaaaactgttcttattgttattttaatagttttccctcagtagaat

SEQ ID NO: 57238 - DNA, 408 bp, Homo sapiens
atacaggtctaaaatgcctgttttgttttagaaactactgttctccccaggattaaaatgtgcaggaagcattcatcccacccttagtttagctgatagccttacccccctcccttttgttttgttgtggatctgaacttattttacccaatggctattttcttgcatttccctctagaggtattggcatttcgagaagcacttcagccttccagatctttacataattcattacggacatattttggacttacagtatcttagagtacaaaaaaaagagactctcctctttatttccagaagttgttacagacttctcctgaatttaaatttcctgaaaatttttcctggacatgctgtaagtttttattccattagggaaccataaacaaaaccacttaccagcag

SEQ ID NO: 57239 - DNA, 350 bp, Homo sapiens
tttttaagatagttctgtttggtagtggaccaactattagttttcagaagggttggtttggatttttgttttaattacagtctatataattagttctcagcatgttgaggtaaaagagaattgtaccagcaagctcccaatttcttcatctcattaggtttttaacacgattattagtatcataatcagctatgatgttttttgttgcaggttttcacattctctgatttgcggggtgtcttgattggctaatttgggcaaattattttgattgtcttgatgatggttggctgattagaacacagcaagggcataatttcttcctgtgaaacgttgcattcttttgtttt

SEQ ID NO: 57240 - DNA, 199 bp, Homo sapiens
tcatcggaagcatgtacaatcccacaattttacattcaatccacttttcagcccagtgtttggattcagcatagcagaaaatatcttgttggagctgctcttaatcacacctggtgaaaggactatatcttaccttgcgaatctttctcctttttctttctttttttttctttcctattgattgggtgggagaagtcat

SEQ ID NO: 57241 - DNA, 543 bp, Homo sapiens
ttaacggtaaatgcgaatgtagttagttcatcttgggcatcagagagcattgtaaaacttgctaattatagtatcctctgagtaagctgatccatcttttggcaaaaattatgttgtgagagacttttcatttgaaaatttcttggctactgactttaattagcagttgatactagaatggactttcatggcgttcacagcctgggatggcccacgtcatctttaaccttgaactcactgatgtttgaattattcagtagctggcttagccatattgaatttcaaataagtgttcaatggtgttagttacttatttctaaatggtacacaacattttaaatgttttgctattgatttatagtgactagtttcctgtctgatttgagaggttctgacaaattttttaagaaacggatgtaaccatgaaatcctaagtagaggacccagctaacctgtacccacaatcctgatacacttgagactgtgagataaatttgtgttgttttattctgtatgataataaaacttacaaataaaatgaaa

SEQ ID NO: 57242 - DNA, 301 bp, Homo sapiens
ggaaaaatataacaaaacaataacctggagacaatatctaggagggaacaattctgggacagcatttcttttttccccacctgacttcagagaggtagcaagtattcactgggaggcatcactttaagccaggtacaaaaacaggctccaactacaaaaagtgcgttttcctaacaaaagtattccaagcaacctccctgtacacggcacattttctgaaaatcaatcaagccctctcattcagctgaagtccaatcgcattgtctgtcccttcctccagaagccgatttctgccaggtag

SEQ ID NO: 57243 - DNA, 369 bp, Homo sapiens
gaaaagataatgaaggaataatgcaaagctgaaggctgtgccagatgtaagaagtgattatgaaggataaaagaaaagggctttccaagcagggaagaggcatcagagagaaaaccaattgttgagccagtattctgtcacagggacatttgtctttgttctttaatgcccagtaagggtcttctcaggttccattaaacatgcagaatcacaagacccccccaaagttaccatggtgccaaccgactcaaaacaatacagacaagaagctcagctcatcaggaaggctgcagcaggcatatgggaaccatctgctccacaaaggacagctgagatgcaaagatccctacaaggtccatatccacggga

SEQ ID NO: 57244 - DNA, 211 bp, Homo sapiens
tttgctttatgaagaagctggcctaggtagggttacaaatgggttttactgaacttaaacagctaattcctacatctctgaaaataatcagaatagaaaaatagatggaaaaatttcaaacccactgtaagagactaacataaatccaattccaaaagctgttaatcataccatctaaaaagaaaactgtcgactaatcatgtgtttacaa

SEQ ID NO: 57245 - DNA, 4078 bp, Homo sapiens
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57246 - DNA, 3742 bp, Homo sapiens
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57247 - DNA, 3950 bp, Homo sapiens
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57248 - DNA, 3567 bp, Homo sapiens
ggaacagatagaatcgagctcggtacgaacgggtgatgcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57249 - DNA, 3546 bp, Homo sapiens
ggaacagatagaatcgagctcggtacgaacgggtgatgcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57250 - DNA, 3504 bp, Homo sapiens
ggaacagatagaatcgagctcggtacgaacgggtgatgcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57251 - DNA, 3525 bp, Homo sapiens
ggaacagatagaatcgagctcggtacgaacgggtgatgcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57252 - DNA, 4031 bp, Homo sapiens
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccaacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57253 - DNA, 1532 bp, Homo sapiens
ggaacagatagaatcgagctcggtacgaacgggtgatgcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctggtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaacctgtgct

SEQ ID NO: 57254 - DNA, 732 bp, Homo sapiens
ggaacagatagaatcgagctcggtacgaacgggtgatgcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcaggtaacgactctgtcccatgccggccgacaagagctccagctcaaggccctggcgcgcgccctgcacgccccgcacgcccagccc

SEQ ID NO: 57255 - DNA, 496 bp, Homo sapiens
caaaattattttcaccaagttacggtttggcattcttccctcgggttactatgcaaagggaaaaaaatcttgtaacactcattaatgcatatatgatagggatacaaacaaaaacattgtcctctatattccttattgaattaaggcctgcaaaaaacttctctgtgaacttctttgaattcttctttttatatgacaaaaaaattcatatgtttgattttgttgtttcattctttagaagttgccccaatgcttggaggcaaaattttagctcaattttattttagacaaagtcttgctctcttgcccaggctggaatgcagtggagtgatctctgctgactgcaacctctgcctcctgggttcaagtgaacctcctgcctcaacctctcaagtagctgggattacaggtgcccaccatcatgcccggctaatttttgtatttttagtagagacgggattttaccatgttggccaggctggtcttgaactcctga

SEQ ID NO: 57256 - DNA, 432 bp, Homo sapiens
caagcattatcttgcttaatttgcttcataaaactatgaaaaacatattatttcagttttataggtgagggatgtaatcgctagtacaatataggaaacacatgtcagagccaagatttgaagttgagtctctcagactccaaaatctgaaactttttcaaatatgccgtcttgttttccacactgatgcttttgacccttgccataaagtcagcatgacctctttgacaatgtgaatacagttaacactgtgcactttgaacaaaagaaaaggaagtaaaaggacaagaccattttcaggcaaaatgaagaatatgcaaaatgtcccctttttttctttctttttgctgatttccttcctaattccctcctcactactcccacctctaagtcaaaagctttttcttctaccttcaaacatctgcagctatg

SEQ ID NO: 57257 - DNA, 267 bp, Homo sapiens
ccaaagggagaagctaaagggtgaaagagggcagaaagagaaagtggaatgagagggcatgagtgcttcatgatgtcatcacaagatttagcttctcattatgccacataaagagtggcagtttcttagttcatttttcttgcttagaacacctgaggctgggtgatttataaggaaaataaatttatttgttacagttctggaggctggaaagtccaagggcatagctgggcatctggtgagagccttcttcctggcagggactct

SEQ ID NO: 57258 - DNA, 461 bp, Homo sapiens
ttcaatttctacaccacagagattgtaacaatttatacaccaaccagaaatgttttctttaccctgggtaagtgttatcaaacattttgatctttgccaattcagtgggtgaatcaatgtgtgatttaatttgcatttttatcttgaatgagagttgaacatcttttcatatatttaagaaccattgggtatttccatttctgtacaccgttggttgttctttgcccatttttctgtaaggctgtggacttttttcttgatctctagattcacttggtatcggtaatccccctataggtgcagtgtaagaatttaaaaaatgaaaacaggctgggcacagtggttcatgcctatattcccagtgctttgagaagccaaggcaggaggattgcctggggccaagagcttgagaccagcctaggcaacatagcaagactctgtctatacaaattttttttaaa

SEQ ID NO: 57259 - DNA, 656 bp, Homo sapiens
gattctccttctccctcctgtccccacattcacccttcctgatccagtaacattcagtttagcaaacatttcttgagcatcttccatgagccaggcactatgctaggcttacaaaggcacaatatctgcctttaggcagccctggcctagcatgtagacacatgttctttaggatttgcccaagggtgatattaagcatgttctatacataacaagtacctactccagtgcctcaacttctttttaacagggtatagagcctttaaatccatattactgatatcgtctatactgcagatattcctagcacaaaagttttgattaaagtgtaaattactattaccaggctggttcctgagagtaggttttaatagaaaaacaagagaaggaactaatagaagaccagtttatataaattaagggatggagagggctcactgggaaagaagtgtaggagccacggtggctcacgactgtaaatcatcccagctacttgggacactgagacagaaggattccttgaggccaggagttcaagaatagcatgagcaacatagcaagactcccatctctaaagaagtgaaaaaaaattagctgggcctggtggggcatacctgtggtcccagctacttcggaagctgaaatgggaagattgc

SEQ ID NO: 57260 - DNA, 370 bp, Homo sapiens
aaattacccagacatcttgaaatcaacctcctgagtagctgggaccacaggtgtgtgccactacacctagctaattctttttattatttttttagagatggggtctccatatttcgccgaggctggtctcaaactctgcagctcaagtgctccgagtcagcctcctaaaatgatggcttgcaggtgtgagccaccaggcctggccccagaatattatttaggctactctaggccactctgcctgtgggtgaaccctactctatctatagagcagccaaaagtatatatacatgtaaactcttagccgggcgtggtagcaagcgcctgtggtcccaactacttgggaggctgaggctgagttcgaggctgc

SEQ ID NO: 57261 - DNA, 560 bp, Homo sapiens
agcccctgggttccccatcattaggaggtcagatgagaaggagccagccatgaagactgggaaggagtggctgttgtggggaggtgggtggtgtcctagacacaggtatctttttaaggcagaggggcccggaaaaggatccttgtagtttgagtagttatgcctctctctgagcatgggcagttcgttggtgaactgacaacgtgaaatacacatgatgcaattccaccgtgtgtcaagtttgaaagcactccctgccagtagcgtgtggggagtgtagggaatggcaattgtaatgagacatcacagtgtaaaattcctgagctctgctctagtacagcctggggacagacgtctgggccaagaagggcttctgtgagacagcatggaacagtggcctggtcagagagacttgggcatgcatctgagggctgtaagcctcagtttccccatctgtaaaatggaactctaatcgctgtctccatctgggaggattttgtgaggattcagagaaactgcacatgaaatgctccaccaggcccaggaacttaccaaggtct

SEQ ID NO: 57262 - DNA, 189 bp, Homo sapiens
atgaaaagtacattttaaaactaaaaagaagacaactcaatttttaaaaaaatgtttttgcgatacatttttacccacacctgggcaacagtgcaccctccacgtccccagcagtctgggcagcccctgcctcacaggctgtcgtgcgggcgtgagtagagcactcgccgggccaggaacacacaaagg

SEQ ID NO: 57263 - DNA, 2741 bp, Homo sapiens
ctctacaagcgggcggtggtgactacacgaggcgccgaagatgctgttgagggccctggagaaacttcagcagaacagggcctctccccttgcaggccgagccggggccctgcgccctccccctccgcccagctcggccaagggcgcatttgctgagcgtctggcggcctctaccggagcacctctgcagagggccgatcctccagcccagagacgacatgtggcgctcgggcgagtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagctgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaattaggaaagtactgcatgatcttacacgaagaaatagaataggcaaacttttatgcaggcagattaataacagaaatacatcatatgttagatacacaaaatatttccctgaggaaaaaaaatcaactgcttaaattttttgggaagaaaaagaaacatttcttaccccacaccacccactacctgaacaatagccaagaaaggaaaggagatgttaaaacaaacagtgttttgatgacattctcagcacttggcccatgtgatcgctgtctctgaaacactgaccacctctccctacagccagcgtgtagtgcttcagtggtgagaaattgtaattgagttattttccattttatttccttgtatgtatttcatgactggacttactgctctgtcagcttttgtatatgaatcttaaatgttcattaaaaaataaaaaatgaactgatcttgtggaca

SEQ ID NO: 57264 - DNA, 2254 bp, Homo sapiens
ctctacaagcgggcggtggtgactacacgaggcgccgaagatgctgttgagggccctggagaaacttcagcagaacagggcctctccccttgcaggccgagccggggccctgcgccctccccctccgcccagctcggccaagggcgcatttgctgagcgtctggcggcctctaccggagcacctctgcagagggccgatcctccagcccagagacgacatgtggcgctcgggcgagtgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagctgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaattaggaaagtactgcatgatcttacacgaagaaatagaataggcaaacttttatgcaggcagattaataacagaaatacatcatatgttagatacacaaaatatttccctgaggaaaaaaaatcaactgcttaaattttttgggaagaaaaagaaacatttcttaccccacaccacccactacctgaacaatagccaagaaaggaaaggagatgttaaaacaaacagtgttttgatgacattctcagcacttggcccatgtgatcgctgtctctgaaacactgaccacctctccctacagccagcgtgtagtgcttcagtggtgagaaattgtaattgagttattttccattttatttccttgtatgtatttcatgactggacttactgctctgtcagcttttgtatatgaatcttaaatgttcattaaaaaataaaaaatgaactgatcttgtggaca

SEQ ID NO: 57265 - DNA, 281 bp, Homo sapiens
caacccagagacacaaaggccaactctatgtgatttaaaaggagtagctgcttggcttccagcctctggctaacatcccatcttcaaagagccttgatggttcaccctactgtcttctggcctctatagctaccctagttgagtaaagttggggtctggactataccccagaaatctagatccccgctgagccaataaggatctgggggagggctgatgagcaggcttcttacagcattctggcccaactctgttcaattgttagtgtctacttagaagat

SEQ ID NO: 57266 - DNA, 2901 bp, Homo sapiens
  misc_feature (42)..(42): n is a, c, g, or t
  misc_feature (47)..(48): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57267 - DNA, 2909 bp, Homo sapiens
gaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57268 - DNA, 2596 bp, Homo sapiens
  misc_feature (42)..(42): n is a, c, g, or t
  misc_feature (47)..(48): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggata

SEQ ID NO: 57269 - DNA, 1899 bp, Homo sapiens
  misc_feature (42)..(42): n is a, c, g, or t
  misc_feature (47)..(48): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaag

SEQ ID NO: 57270 - DNA, 2509 bp, Homo sapiens
  misc_feature (42)..(42): n is a, c, g, or t
  misc_feature (47)..(48): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagaaaaaaaaaaaaaaaaaaaaaaaaattggggggggccgggccccggaaaaaattttaaaccctggttggggcggcgcggggcccacgatgggttaggtgtgaacaggggccacatgaggcgggctcccaaagaaaaatcccgggccagggctatggctggcgggggtttctcccccaaataaaaaaagggccggggcgggaaaccacgcagcgtcttcgtgcacaaccatcccgaagtgggagagttcgggagggccatagcggggcccacaacagcgggcgtcccagaggaagcgaaatacaatttaagccgcgccgcctgtggagcaaaaccagaccttacagaacacacaatcaagagaagaaaaagaaaacaagaaaagaagaagccaacccaagatacaacagcgaggcaaaagacgaaaagaaagaaaaagagagagaaacaagacaacagaaaaaagaaaaaccaacaaaaaaaaaacagacaccaaaaaaacaacgaccagacaacgcagagcgaacaagaaaaacgcaaacagaacagagagcagccaaaaaataagagagaaacaactgagcaccactaaaaagacagaaggacatgaga

SEQ ID NO: 57271 - DNA, 1957 bp, Homo sapiens
  misc_feature (42)..(42): n is a, c, g, or t
  misc_feature (47)..(48): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaaggaggaaaaaaagaggaaagcaaccaaaaaaaaaaccaaagacacagatgaaaacagga

SEQ ID NO: 57272 - DNA, 2877 bp, Homo sapiens
ggccatgagcatatccctgacgtcgtggcacaagagctgacttgatctgtccctatgcggcctgtattgatatccgtgatcagcactaagagttggggaccatgacaacgaagacgcgagggtgaggtgcgctgagcgggcgtccgctgatcgcggtgtgcagatgcatgagagctcaatacacagggtatcagctgagtaaagaatcgcaagtcagaacgcctctattgctttgaggcccggaccaagttgccaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57273 - DNA, 2866 bp, Homo sapiens
  misc_feature (42)..(42): n is a, c, g, or t
  misc_feature (47)..(48): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57274 - DNA, 2937 bp, Homo sapiens
gaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacatcaatgacatttttttcctctcacttaggaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57275 - DNA, 2565 bp, Homo sapiens
ccaactctagatgatccagagttagttataaaatagatgattgcatctaagtccaagaatggatgtcataggaaatatgtttttgtcaagatgactattttattattgtagtttgtcaatttttcttacagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57276 - DNA, 2752 bp, Homo sapiens
tcaggttttcatgccaataatttattgaacggaggtctgtacacaggcaaaccttactgtggaaactaaaacatcaggagctctctccactcccctggccctccagggtggggtgaggagggagtagaccttgggggcagaggacaggaggggagttacagctgtaggaggggcggggcaaggttggacggtgcgaatcgacgttttctttaagaaaaaaattataacaatctatttacacccgggggccagggaagggaagaggagacgggctgggctggttctatttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57277 - DNA, 2489 bp, Homo sapiens
gcggccgcctactactactaaattcgcggccgcgtcgacgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57278 - DNA, 1107 bp, Homo sapiens
  misc_feature (42)..(42): n is a, c, g, or t
  misc_feature (47)..(48): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaagtcccaacctgcggttccccctttggagcccgaatctcggtctggggcaatggtagg

SEQ ID NO: 57279 - DNA, 1066 bp, Homo sapiens
gaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaacttttcacaaagagacacgaaggacgagagtctacggatgggtatcgagtatgcctgacctcatgagtaggagtcgaagttagagggctcggacaggattgggggacccggaaaagagctgtaaaaggtaagtgccaaagacacatggcacataaaggatgtgcacaactgagggagcatattcagagtgaaccacccc

SEQ ID NO: 57280 - DNA, 1673 bp, Homo sapiens
tacggctagtggggacgggtgtgaatcggcgaggggatgccgtgcggataagccaatatacactgaggcacacaagatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaat

SEQ ID NO: 57281 - DNA, 811 bp, Homo sapiens
gaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaaaaccaaccagctaacagcgaccctcgggagggcccacaggacactccgtgtaccacggcaatactgaatgtgctgatggaggcagtgccagttctctgtccccttctgccagcactgacagtagaagatattgctatag

SEQ ID NO: 57282 - DNA, 628 bp, Homo sapiens
  misc_feature (42)..(42): n is a, c, g, or t
  misc_feature (47)..(48): n is a, c, g, or t
  misc_feature (287)..(287): n is a, c, g, or t
  misc_feature (294)..(294): n is a, c, g, or t
  misc_feature (317)..(317): n is a, c, g, or t
  misc_feature (321)..(321): n is a, c, g, or t
  misc_feature (335)..(335): n is a, c, g, or t
  misc_feature (342)..(343): n is a, c, g, or t
  misc_feature (345)..(345): n is a, c, g, or t
  misc_feature (356)..(357): n is a, c, g, or t
  misc_feature (412)..(412): n is a, c, g, or t
  misc_feature (453)..(454): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (477)..(477): n is a, c, g, or t
  misc_feature (497)..(497): n is a, c, g, or t
  misc_feature (513)..(513): n is a, c, g, or t
  misc_feature (516)..(516): n is a, c, g, or t
  misc_feature (520)..(520): n is a, c, g, or t
  misc_feature (523)..(523): n is a, c, g, or t
  misc_feature (533)..(533): n is a, c, g, or t
  misc_feature (549)..(549): n is a, c, g, or t
  misc_feature (556)..(556): n is a, c, g, or t
  misc_feature (598)..(598): n is a, c, g, or t
ccatcacaccccccccacaccaccaaatactgctagtacagnctggnntgtggcctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaataagaangtggtgncattaattaagattagaaagttnggantgtataacatgctntgtacanngnactaataaacnnaacaaaaacacataaatcgcttaccagccgcaaaaacatcctgcaaaccatacangcagcagctgttacatgccagtcacgaactaggactgatanngtaggaccanctgcancnatctnccgcataagatggccgtaanagagaggtctgtgganccncganccnatggaggagnaacagaaggatcggangcgcatncagaaacaattagatgcaaccgcaacagtgtgcttgcaggantatacgcatgaagtggagacgggcgcctac

SEQ ID NO: 57283 - DNA, 470 bp, Homo sapiens
gcagaattacaaaagtgcatcccttgcttcccctaacatgataaactgcttatggagagtaagtgtgcctaagacatgagtaacctggctctgagctcggccagagaaggggaaattagaaattgtcctgggcttttggacatagagaggattcttcttgcgagtggaagatttgacctggagaaggtcaaaaccactgtaacgttagaggcaccagtgccttcaagtgttaagatcagaatccaccaattactgaaactcagctcattttttttctactttatttagaaccttaaaacaggctttaaatgaatcttgatttcacagtgctattttattactatttcattataaataaaacatataggagaattgaactcttaaaaccctaactttgcctgaatgtgtctaggtcagtggctttgtatgactgccgaagtccagatgaaagccatcgaatgtggcgattc

SEQ ID NO: 57284 - DNA, 375 bp, Homo sapiens
attggtgtagcaacgtgggttcaccaaaacacctttttatacaaaagacagatgtgtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggt

SEQ ID NO: 57285 - DNA, 554 bp, Homo sapiens
cagtcatcttctgacctcctcattacctctcacatgaattgaaaatttaacccctgacccactctcttgccaccttcattctggacagtagtactgctgctaccatcagtgtttactgattattgtgctcttaaaatgtacctaccccattaccccatgcttaccatttcagataacattgcctcatttaatcctaacataaaccatataaggcattcttttttacacattacaaatgaggagactgaggctccgactaattaactaacttgtccatcgtcacatagctagtaagtagtgaagctgggatttgacccaggtctgtttgactccaagccaattagtttttagctttcacagagaaatctcaaacattccttgaacagtcttatctcctcaattactgactcttgatattcttataggtacctcatacttacagttttcaagatgaaatttatcgtattctgttcaaggttacacttttgcttgtgattagtacttatctagagttgcccaacctagaaacaagggagtcttatactcatgtttag

SEQ ID NO: 57286 - DNA, 222 bp, Homo sapiens
gccaatcataacactttctaattggcacaaaatccacctacctgttgcctctcaggcttgggtaacatacttcagacactttcttaggtaagtcttggcccttggggtgttatttgcccagatggtaaaaacatttaagtaggtctgattatttcattttcagtggtttcaacgcatttttgtggcctgggtggttactgtaatgtgcccaagttgttcatt

SEQ ID NO: 57287 - DNA, 202 bp, Homo sapiens
gctgttctctcccattctccttaagtcaccaaatctcatgtctttcaacatctgttctatctaggagatctccgtcagcttacctgtgagcactcaatttttttgtccttaacctctgactttggaggggaagtatttccattcccttgaaatactacccaagccccaacttgtggtcatggtcccactccttccagactcc

SEQ ID NO: 57288 - DNA, 417 bp, Homo sapiens
gccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgct

SEQ ID NO: 57289 - DNA, 499 bp, Homo sapiens
ttctgtcgtttgcatcaacatggattaacttggagccattgtgttatgtgaagtaagccaggcacaggaagataaatgctgcatgttctcactcatctgccgaagctaaaaaagttcatctcatagaaggagagtgtacaataatggtcactagaggcaaggaaaagtttgggagaggggtttatagccaaaggttgattaatggtacaaagtgcaactagataggaggaataagttctagttttctatagcactgtagggtgagcataattaacaatttattgttaaattactgataagtctagtaatgttgcaggatacaaaatatacatacaaaagttggagacatttatatacattgataatgaactatccaaaaaagaaaataagaaggcaattacatttccagtaacaacaaaaagaataaaatgcttgaaaataaacttagccaaagaggtgtaatacttgcacactgaaaactataaaacacgatgaggaa

SEQ ID NO: 57290 - DNA, 3891 bp, Homo sapiens
tgcatccatgtctgccagcctctgtggccacacgtctccaacctgtctgttcttccacgtctgtctctgaccttgggtcctgtggcctggcagcacaagggcattgagggtgggaagcatgctgcttccattggcctagcccatggagcggggccgagggatcactgggatttttggaggggatagggattaataactggccttcgagatgccttgtccctcctgtcccacagctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatga

SEQ ID NO: 57291 - DNA, 3968 bp, Homo sapiens
gcatgtcattcctcacatgatgcccatccatgggtttcagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatga

SEQ ID NO: 57292 - DNA, 1995 bp, Homo sapiens
gggaggcaggcctgccaatgacccatcttctcccccgccttccccagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatga

SEQ ID NO: 57293 - DNA, 6879 bp, Homo sapiens
  misc_feature (236)..(237): n is a, c, g, or t
  misc_feature (2611)..(2611): n is a, c, g, or t
cgtcctctttgtgttcttttactgtttgtatctgctctaatgggctcccttcttccaatctcgtttttttcgctctttcccccgttcagtgcacggcccccttttgggagccccccccctgcttccaagttttccacaaagggcggacggcacaggctgcagcgaccaagattgagaccactggtccccagcggtcccgttccctgtcgctccaacccgcggggttggccttgggnncgccttagctggagggcccccgggtgagacgttcggccgtgccacagaacttgacccggcagagaacctttgctccgtctcgcgtcctcttcccacactccgtgcgctgctttcggcgtgggccctgcgctcctagggagtggggggccagggggggttgccccggctgccccgaggccaagcccccccccgggtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattnagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcagggtggccctccggtgcatgtgggcac

SEQ ID NO: 57294 - DNA, 6517 bp, Homo sapiens
  misc_feature (236)..(237): n is a, c, g, or t
  misc_feature (2611)..(2611): n is a, c, g, or t
cgtcctctttgtgttcttttactgtttgtatctgctctaatgggctcccttcttccaatctcgtttttttcgctctttcccccgttcagtgcacggcccccttttgggagccccccccctgcttccaagttttccacaaagggcggacggcacaggctgcagcgaccaagattgagaccactggtccccagcggtcccgttccctgtcgctccaacccgcggggttggccttgggnncgccttagctggagggcccccgggtgagacgttcggccgtgccacagaacttgacccggcagagaacctttgctccgtctcgcgtcctcttcccacactccgtgcgctgctttcggcgtgggccctgcgctcctagggagtggggggccagggggggttgccccggctgccccgaggccaagcccccccccgggtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattnagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggaggtagcagggggtgggggaatggaattggtgccatgggatgagctaggtccgtgtgacagggagatggagaccatggtaggggcataagcagcatccagcagagggctagggccttcctctgaccacagagtgacgctggccagtccctgtcctccttcgatcctcatttcttctgtagctgatgaggaatacagtaagtgtcccatatacattaggaatcttattcatcctcctgcccaccctatctctcaactcaggttttagggtcctttggggataggacaagagtcctttctgatgtcaacatccattagcattagactctggcatttattgctgcacatgtcacttgcacacatgtcagaagtatccaggggcaacgggttcccttaatttccctcacttattccattgttggctgggcaggagtccaaagccctgggttcaggccccagctctgtgactgacttgctgtgtgacctttcccttctaggcttcagcttccccacctgtccaggggga

SEQ ID NO: 57295 - DNA, 456 bp, Homo sapiens
tggattacagaattgcgagctgcggtacccccgtgtgggttctttgtgctggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatga

SEQ ID NO: 57296 - DNA, 7943 bp, Homo sapiens
  misc_feature (236)..(237): n is a, c, g, or t
  misc_feature (2611)..(2611): n is a, c, g, or t
cgtcctctttgtgttcttttactgtttgtatctgctctaatgggctcccttcttccaatctcgtttttttcgctctttcccccgttcagtgcacggcccccttttgggagccccccccctgcttccaagttttccacaaagggcggacggcacaggctgcagcgaccaagattgagaccactggtccccagcggtcccgttccctgtcgctccaacccgcggggttggccttgggnncgccttagctggagggcccccgggtgagacgttcggccgtgccacagaacttgacccggcagagaacctttgctccgtctcgcgtcctcttcccacactccgtgcgctgctttcggcgtgggccctgcgctcctagggagtggggggccagggggggttgccccggctgccccgaggccaagcccccccccgggtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattnagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatga

SEQ ID NO: 57297 - DNA, 8244 bp, Homo sapiens
  misc_feature (236)..(237): n is a, c, g, or t
  misc_feature (2611)..(2611): n is a, c, g, or t
cgtcctctttgtgttcttttactgtttgtatctgctctaatgggctcccttcttccaatctcgtttttttcgctctttcccccgttcagtgcacggcccccttttgggagccccccccctgcttccaagttttccacaaagggcggacggcacaggctgcagcgaccaagattgagaccactggtccccagcggtcccgttccctgtcgctccaacccgcggggttggccttgggnncgccttagctggagggcccccgggtgagacgttcggccgtgccacagaacttgacccggcagagaacctttgctccgtctcgcgtcctcttcccacactccgtgcgctgctttcggcgtgggccctgcgctcctagggagtggggggccagggggggttgccccggctgccccgaggccaagcccccccccgggtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattnagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatgactgcattggtggccacagtggcctcctgtcagcaacctcagggctcagtctccctggccacatgggccttccgacgtccacacacttgggaagaagggaggccttggagacccagaagagtgctggacggcgaggttgccacgatttgctgtgttacctgggcaggtggctgggctgcagtttcctcatcaggaaaataaaggggttgtaccagttcagtgctttgtaaccagggttacatggtagaatcccttgcagatgacatgtaaatgcagaaacatgattcgtaacttatttacgt

SEQ ID NO: 57298 - DNA, 1269 bp, Homo sapiens
caccttatttataagagttgtgctagccccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatga

SEQ ID NO: 57299 - DNA, 6510 bp, Homo sapiens
  misc_feature (236)..(237): n is a, c, g, or t
  misc_feature (2611)..(2611): n is a, c, g, or t
cgtcctctttgtgttcttttactgtttgtatctgctctaatgggctcccttcttccaatctcgtttttttcgctctttcccccgttcagtgcacggcccccttttgggagccccccccctgcttccaagttttccacaaagggcggacggcacaggctgcagcgaccaagattgagaccactggtccccagcggtcccgttccctgtcgctccaacccgcggggttggccttgggnncgccttagctggagggcccccgggtgagacgttcggccgtgccacagaacttgacccggcagagaacctttgctccgtctcgcgtcctcttcccacactccgtgcgctgctttcggcgtgggccctgcgctcctagggagtggggggccagggggggttgccccggctgccccgaggccaagcccccccccgggtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattnagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggaggtagcagggggtgggggaatggaattggtgccatgggatgagctaggtccgtgtgacagggagatggagaccatggtaggggcataagcagcatccagcagagggctagggccttcctctgaccacagagtgacgctggccagtccctgtcctccttcgatcctcatttcttctgtagctgatgaggaatacagtaagtgtcccatatacattaggaatcttattcatcctcctgcccaccctatctctcaactcaggttttagggtcctttggggataggacaagagtcctttctgatgtcaacatccattagcattagactctggcatttattgctgcacatgtcacttgcacacatgtcagaagtatccaggggcaacgggttcccttaatttccctcacttattccattgttggctgggcaggagtccaaagccctgggttcaggccccagctctgtgactgacttgctgtgtgacctttcccgttaggagctaatcggacgagctcgaat

SEQ ID NO: 57300 - DNA, 768 bp, Homo sapiens
agcctgcgctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaagagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccg

SEQ ID NO: 57301 - DNA, 853 bp, Homo sapiens
agcctgcgctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaaggcgccctgatctggttgtggaagtggcccatcccaaaataatccatgaatctggggcacaaatcctgcgccatgccaatctcctgagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccg

SEQ ID NO: 57302 - DNA, 703 bp, Homo sapiens
agcctgcgctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctgggtgcggccaggcccctctcccccggccctgggctcctgtgttctgcagagcttgggggtcccgggctctcactagttctgcagttctggttctgtatttgttgacctttctttctttctgacctttatttccttaacctctctccatgactttgaatcctggcactgtagatgtctccatttgtgcccgcctctgatcgagactctctctgtctctgtccacccccagggctctgtcccgctctctccgggtcttcctccaccgcccccctgccctgtcccctcctcccaccactgcctcccccaggcgtctgtctcctcatctctcc

SEQ ID NO: 57303 - DNA, 1003 bp, Homo sapiens
agcctgcgctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaaggcgccctgatctggttgtggaagtggcccatcccaaaataatccatgaatctggggcacaaatcctgcgccatgccaatctcctggtggggtccccctcagctctaagtgaccagaccacagagcggcagctcttggaggcctcacagcactgggaccacgccgtgtttgtggcccgaggggccctgtggggcgctgaggacatcaggagattggatgcagctgggggcctccggagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccg

SEQ ID NO: 57304 - DNA, 1024 bp, Homo sapiens
cgagcagcccagggagccaggccccagacaccgcactcagggccatggccgacaggggcccgtggagggtgggcgtggtgggctatggccgcctcggacagtccctcgtctcccgcctcttggctcagggaccagaacttggcctagaacttgtttttgtctggaatcgtgacccaggacgaatggcagggagcgtgcccccttccctgcagctccagaaccttgctgcccttggggaaaggcgccctgatctggttgtggaagtggcccatcccaaaataatccatgaatctggggcacaaatcctgcgccatgccaatctcctggtggggtccccctcagctctaagtgaccagaccacagagcggcagctcttggaggcctcacagcactgggaccacgccgtgtttgtggcccgaggggccctgtggggcgctgaggacatcaggagattggatgcagctgggggcctccggagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccg

SEQ ID NO: 57305 - DNA, 778 bp, Homo sapiens
cgagcagcccagggagccaggccccagacaccgcactcagggccatggccgacaggggcccgtggagggtgggcgtggtgggctatggccgcctcggacagtccctcgtctcccgcctcttggctcagggaccagaacttggcctagaacttgtttttgtctggaatctggcccatcccaaaataatccatgaatctggggcacaaatcctgcgccatgccaatctcctgagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccg

SEQ ID NO: 57306 - DNA, 1072 bp, Homo sapiens
agcctgcgctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaaggcgccctgatctggttgtggaagtggcccatcccaaaataatccatgaatctggggcacaaatcctgcgccatgccaatctcctggtggggtccccctcagctctaagtgaccagaccacagagcggcagctcttggaggcctcacagcactgggaccacgccgtgtttgtggcccgaggggccctgtggggcgctgaggacatcaggagattggatgcagctgggggcctccggagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccaggtgagcagagctaagcagggtgttgggctgagtccaggctctccagactgactgcccctcttgtcccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccg

SEQ ID NO: 57307 - DNA, 378 bp, Homo sapiens
attggcatgaattatcacatgtaatccacgactctataaggaagacaatataatcttcattttacagagggaggaagtgaatagagcttgagggaggtagcctgaggtcacacagccaatggaggagaaggattcaaatccaggcagtctgactctaaactcgccactttccatcactggtctcactactgttctctgctatgatgtgtgccaggatattcccctacccctaaggaggtcctggtgccccaagaagaaaatgtccaacatcctatcaatgcctaagtatattcctgaggaaccaagtcaataggaacagaatacgcccccaggaagcctttggttctggtgtgaaatcctcctgagcaatgtgcactc

SEQ ID NO: 57308 - DNA, 3287 bp, Homo sapiens
tcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttatggggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccggggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacc

SEQ ID NO: 57309 - DNA, 2801 bp, Homo sapiens
aggtgggaggaggagccataagatggaccttatccctcaggccgctgcagggttgccaggggagaggaggagacactggactaacctgtgccctttggtttccagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccggggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacc

SEQ ID NO: 57310 - DNA, 3637 bp, Homo sapiens
tcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttatggggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccggggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacccggtgtggctgcctggatgagtccttgggggtaggtctcactcagaccctggcagtgatgtgggagggagagaggcagtgctggtagaagcagctccagaagcaaaggcaacagcagtagagtgaccacggaagcggcaaacattgtcttcccttctctaccttccctagtgccacctgcagggaggcccaaagcaaagccccgttgccctgcattgggctggcactgcagaaataagatgaaacacagttatcgagaggatgctgaacatctatgagcaggttttaaagccaagatgagtctcatctgtttgtgtgggtcaggaacgggtcttcctgaaggcatgaggt

SEQ ID NO: 57311 - DNA, 1825 bp, Homo sapiens
cccctctctgctccgcccctctctgctccgcccctctctgctccgcccctctctgctgctccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacc

SEQ ID NO: 57312 - DNA, 3222 bp, Homo sapiens
tcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttatggggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccggggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccactatctccctgtgacgggtgaacttcgtgtactgtgtctcgggtccatatatgaattgtgagcagggttcatctattttaaacacagatgtttacaaaataaagattatttcaaacc

SEQ ID NO: 57313 - DNA, 3418 bp, Homo sapiens
tcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgaggtaggagatgccacctcactgccggggtgtggagagggtgcctcaccggggaaggcaaggcgagggccagatgggaaggcaaatgcttccaggaagctttgccttccacagccctggatgaagacctctggtacgcaccagaaggcgtccagaagatccttatggggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccggggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacc

SEQ ID NO: 57314 - DNA, 3253 bp, Homo sapiens
tcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttatggggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccggggagtcctcgagcctggggctgccctacctctacccattccctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacc

SEQ ID NO: 57315 - DNA, 2627 bp, Homo sapiens
tcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttatggggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccggggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttactgctcctgagcctccactatctccctgtgacgggtgaacttcgtgtactgtgtctcgggtccatatatgaattgtgagcagggttcatctattttaaacacagatgtttacaaaataaagattatttcaaacc

SEQ ID NO: 57316 - DNA, 812 bp, Homo sapiens
gaacctttacactgttctttttcttttcagctgtttgaagatacttttccccattgaaatgttttagttccaaatgcagaaagtgattttattcctctccctactaccagttactactataaaaatgaaaaaaattgtttattggcataagttttgtaatgtcacacacccgcatctgtagctgttgatgacaattccaagatagtcttcaagctatgcataaatcagcaaacaggcccttttgaggattggaaggatagtgacttcacttgcctggttgtaagctgtaacactgattaaacatgcatttggtgcttgctgagtaaaggagctgcaagctgcacttggagacatggtgttgcataacagcgtgttgtgcctctgttctttgtcaggcaggcgcacattgaatcctgtaataacaatgaagtatgtgtaaaggagctaaatttgaagacatctaagggttttctgatgaagctcttcatggcaaaaatagaatgaaagaattcaagattgaagtagtttttatgttgttttgtgctttaacaggcaggtttttattaagggtttattatctttatccattcttgttgcttgctgaccaccggtacacattaatttacaataaaagcacatgtcttaaaaggagagcataaatcagctctacattagttttccaagttctcctcttggtggggggggtcttcaaaatctttaaaaaaaagcaaatgacagacgacgccggccgttaagttaataataaggggtatcccggctagacgggcccggaattagtaggggttccagct

SEQ ID NO: 57317 - DNA, 413 bp, Homo sapiens
ccagactaacctgtctcgcttttcccctccgctgcggccactccctgaacctcagaagaggaggactggagagaggacgaagacggtagtacagcctttccttctgtggtgctttctgctgcctgctgtcccaagtgcagcctccttgtccaggggccctgttctgggggctggggggtgtgagtaggcggcagggacggagtgggtcagtcgtttcctcccctgcctcccaggggccaggatcacagttccaagctgatcatcatgcctgaacttcagggccactggctcctcttcctggttcctggatccttcccctgggttgggtggtgggagggaccaaggctagctggtctcccaagctgctccaaatgtggccatagaggggacctggcacctggaagacagcagcg

SEQ ID NO: 57318 - DNA, 272 bp, Homo sapiens
aaaaaattagctgggcatggtggtgtacacctgtagtcctagctaattgggaggctgaggcaggaggattgcttgagctcttggagtttgaagctgcagtgagctatgatcatgccactgcattctagtaagactctgtttctaaataataatcataaatacataaaagaaggtagggtaatagtaggaacacagattctagaagtactaaagataagaaatacttagcattaactcctctgatctattttccttgactacatttatctaag

SEQ ID NO: 57319 - DNA, 151 bp, Homo sapiens
gatatattacaaatgagcattcagtaagtcatctcaaagatattatatacagatggtgtcaactacacattcaataactgacagttattaggctcctgaagtctgccagtaatgccttacaggttgtgtcagtgatatccttgtagtgttt

SEQ ID NO: 57320 - DNA, 5031 bp, Homo sapiens
tctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctggggggtggggagttggcccagagtcttaagattggggcagggtggagaggtgggctcttcctgcttcccactcatcttatagctttctttccccagaatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57321 - DNA, 940 bp, Homo sapiens
ttttttttttgtggggaaaagtgagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggcatcgaaaaccgggcatgaaggatga

SEQ ID NO: 57322 - DNA, 736 bp, Homo sapiens
  misc_feature (35)..(35): n is a, c, g, or t
gggcccagcacaaagtcatgaaccatagcacacangatcaaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagagagtctggagtgcgtcaaaccattgagacggggcgcatccatctaagagatcgagccatgcagtgcatagcaaaggctttgggagagtggaccgtacgtattaaccatacatgcagatgactggggaaacaatgcgtgggacgaaaaacacacaaaccaaaaaacacaaaaacagcagcaacaaacaaaaaaaaaaaaaaaaaaaaacaaaaaaaaaggaagggagaaagacgaggggaagagggagggcaaagaggaggagaaggaaagagagcagaagagggaggagcaggccagcaagcaaggaaacagggaagaagacagccggacaggaacgagagtaaaggagggcgagaacaaagcacagaggcagaaagaggcgggagaggacaacagacaaggagacggagggggcgacggacagagaaaaccagagtagaaggcacaggacagaaaagagaagaaaacacgggggg

SEQ ID NO: 57323 - DNA, 579 bp, Homo sapiens
aaaaaaaaatggcatggataggccgtggttttagcttggcacgaggcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagagagaaaacccactatcgattccac

SEQ ID NO: 57324 - DNA, 554 bp, Homo sapiens
gtaccgacagatccctaaccagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaaataacatggttgttgtccagggtgataaacaccagatgatgagtgaaggaaagatacatcgactacg

SEQ ID NO: 57325 - DNA, 423 bp, Homo sapiens
gagctcggtacccccaggtagacctaacctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttgtaagaggaaccagggagatggaggggcaagggtgggcctgacaagacaagtgga

SEQ ID NO: 57326 - DNA, 5524 bp, Homo sapiens
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57327 - DNA, 5423 bp, Homo sapiens
ctcagagacccactttattcagttctgtacatatggggacatcggtccaagcccaacccaccttagcatgtatcactctgtggagaataaagcaccctttctcaccgacctcttcctgagcgccactctttcccaacaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57328 - DNA, 5227 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57329 - DNA, 5343 bp, Homo sapiens
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57330 - DNA, 4938 bp, Homo sapiens
tctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctgggggatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57331 - DNA, 5144 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaaggtgctggggggaccctgatgtggcaccaaatgaaatgaacaaagctccacagtccacaggccccccacccgccccatcccccggactcccacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57332 - DNA, 4707 bp, Homo sapiens
ggtcggtacctctcgaattcggatcgtcttacgctccctctgggagcatctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57333 - DNA, 4348 bp, Homo sapiens
ttttttttttgtggggaaaagtgagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57334 - DNA, 4315 bp, Homo sapiens
ggccgccctttttttttttgttttaaagtgaatatacaatttatttaacattcaaacttcattaagacatgtgcaatatggcaattttactggggattaaaccctacctaggattgcttgctggggcttagcaacagggtccagttcacacttagcactaattaaatactttattgaataaatacaataccaaacaaaatgctttcaaatgctttctaaaaaaattttaaaggcctttctactcaggctaatgacaaacacaataaaggcagatatgctagtttaacataattggctgattttatacagcacttatatcttttagtccacaagttaatattattaaatgatagagaacatctaatacaaccatttctacagaactaggaaataaatttctaagaaagaaagattttacagaccccatcttttatacccaccccaacagtctaactctaaagaggataaagccaatgactttcctcacaagagctcacgattaacgtcgctttgctatcaaaatctgtatttctgatccgttatgagctttgagacaagattcaaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57335 - DNA, 3712 bp, Homo sapiens
tcgatctaaggatcccattagactaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57336 - DNA, 5192 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57337 - DNA, 2951 bp, Homo sapiens
cggtcaggtaggaggctgggtggtcagtccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57338 - DNA, 2955 bp, Homo sapiens
agctcggttccctactctgaaagacatccagtccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57339 - DNA, 5210 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaaaataaggcagggccgaatatacaacccgctct

SEQ ID NO: 57340 - DNA, 5237 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcaggcacccacaccccactcattggagaatggaaaacaaaccccgaaacaacaccaaaaaaatgtgcaatggatgcattggaattatatgtcattgtataaatggtgcaacagtaataaagttaaacaattaaaaa

SEQ ID NO: 57341 - DNA, 2673 bp, Homo sapiens
cgaatggatcagtatttcaaccagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57342 - DNA, 2786 bp, Homo sapiens
agttgtcatttctccccaaataaatctatagattcaattaagttcctacaaaagtctaaacaggctttttcagggaacttaaactgattctaaaatggttatgaggccaagcatggtggctgatgcctgtaataccagcactttgaaagtgaggtgagcagatcacttgagctcgggagtttgaaatcagcctgggcaacaaggaaaaaacccatctctagaaaaaatataaaaattagctgggtatagtggcacatacctgcagtccctgctacttggaaagatgaggtgggaggattgcgtggcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57343 - DNA, 2445 bp, Homo sapiens
tcggtaccagcccgtgacctcctggcaagacctggactttgaaaaaccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57344 - DNA, 2421 bp, Homo sapiens
aattaggctaggtagaggcgggggtatcggacgaggaaggatcagtattaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57345 - DNA, 2253 bp, Homo sapiens
cgctagtacgagggatggggttgaaatcggccgatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57346 - DNA, 4626 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57347 - DNA, 4476 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgatcgtccgtctcccttcacaaagtaaagagactctccccgagacacatta

SEQ ID NO: 57348 - DNA, 4705 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagagaatctggggatcatttgtttctcccatacagccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaagtattccgcgctgtctattccggagatcctc

SEQ ID NO: 57349 - DNA, 4458 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagagtaccccaacctgagtgatccagccagatagtatccacaccctatgtatcagacctctcccacgtctatcatcgacttccgctatag

SEQ ID NO: 57350 - DNA, 2034 bp, Homo sapiens
gagggcttggctcctgaggcctccgctgctgcccctgccccagctcagtcgccctccaggtgcaaagagctggttgttagaatcgatggagccaggccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57351 - DNA, 1877 bp, Homo sapiens
aaccaaactcttctcagtcgatgcccggtgttattcggccgaggcagaggcagtggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57352 - DNA, 1874 bp, Homo sapiens
tatgagctcgtaccttccaccagcaagacagatatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57353 - DNA, 1901 bp, Homo sapiens
cggaatacacagcgagaccaaggttttgttaaacaaaacagggttccaggaagcggaggttgcagtgagccgagattgcgagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57354 - DNA, 4614 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaaggtttggggatggagttgggttaattctagcatttgaggctggccagtcttctttcttgtctcctgttggcaaccttacctcttaactgcgggccttttccattgcagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttgtaagaggaaccagggagatggaggggcaagggtgggcctgacaagacaagtgga

SEQ ID NO: 57355 - DNA, 4164 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcttgctggtggaaggtaccgact

SEQ ID NO: 57356 - DNA, 4238 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaaataacatggttgttgtccagggtgataaacaccagatgatgagtgaaggaaagatacatcgactacg

SEQ ID NO: 57357 - DNA, 1722 bp, Homo sapiens
tttatgatgcttttccttctgtgtacgtaggtcgaccttagagcgtatacacatagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57358 - DNA, 3878 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccaggcgtgcaggagctggcctcaccctcctcgctcgatctggaacggatggggcgagttaagcgagacgcatgccatggcaaacatatcggggaggctgcacacggccggcg

SEQ ID NO: 57359 - DNA, 1299 bp, Homo sapiens
  misc_feature (19)..(19): n is a, c, g, or t
  misc_feature (26)..(26): n is a, c, g, or t
catacgtctaggtacgagnctgggtntgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57360 - DNA, 3570 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctacacacgaacttcaagcaggaggaggaggattcgcctaagctcctcgaga

SEQ ID NO: 57361 - DNA, 1271 bp, Homo sapiens
tcatcgagctcggtcccactttaccagtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57362 - DNA, 1141 bp, Homo sapiens
gagctcggtacccccaggtagacctaacctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57363 - DNA, 3546 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaaggtaggggtgtgtgtgggagtgggtgattcagctcaggtttagatcttagtcccttcacttttctaaagttgagaaggtgacagctgaatgtttcctcttagactaactggttggattgctggagacaggactgccagctgtagagggagggtggtactcccattagtctggaccagtgtttggcaaacacacacacacacacacacacacacacacgtgccagatccagcccattcatacatcccaggacccagtagtggtttttacattttaaagttgcgaaaaatcaaaaagtgaatggtaatttatgctgtggaaattaaataaaatgtaaatgtcagtgtcca

SEQ ID NO: 57364 - DNA, 834 bp, Homo sapiens
cccgcgagaattcctgctgctcccgcgagaattcctgctgctcccgcgagaattcctgctgccccgcgagaattcctgctgctattcctgctgcaccccgcgagattcctgctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57365 - DNA, 2983 bp, Homo sapiens
  misc_feature (2944)..(2944): n is a, c, g, or t
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaantgggtgccacgccgaggggccccatcctcagggagccgg

SEQ ID NO: 57366 - DNA, 822 bp, Homo sapiens
gtgggcactggggtcggttgtgtttcaggggttataggacacgttgcttgggaaggctacccagcagctaggggttgaggagaaagagggcccgaacaggtgatgcttgagttgagtcctgaaggaacaagacacgaggaagtttccggcaaaggatatagcatccacaaaagtgtcaaggccagagaagacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57367 - DNA, 627 bp, Homo sapiens
cttagcaggatgcttagaggcacaaggaggcagaggcacaagtaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57368 - DNA, 2741 bp, Homo sapiens
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagagagaaaacccactatcgattccac

SEQ ID NO: 57369 - DNA, 2717 bp, Homo sapiens
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaacctcatcattcatctttgtctttctca

SEQ ID NO: 57370 - DNA, 2314 bp, Homo sapiens
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaccaggtagagagcctgcaggggatcttagatgacaggca

SEQ ID NO: 57371 - DNA, 2480 bp, Homo sapiens
  misc_feature (2466)..(2466): n is a, c, g, or t
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaaccnatcagcctctgggt

SEQ ID NO: 57372 - DNA, 396 bp, Homo sapiens
gccgacgcctactactactaccaaattcgcggccggtcgacgtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57373 - DNA, 1935 bp, Homo sapiens
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggcatcgaaaaccgggcatgaaggatga

SEQ ID NO: 57374 - DNA, 915 bp, Homo sapiens
cctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccagactgaggaagacccggaaacttaggggccacgtgagccacggccacggccgcataggcaagcaccggaagcaccccggcggccgc

SEQ ID NO: 57375 - DNA, 546 bp, Homo sapiens
ctcagagacccactttattcagttctgtacatatggggacatcggtccaagcccaacccaccttagcatgtatcactctgtggagaataaagcaccctttctcaccgacctcttcctgagcgccactctttcccaacaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggggggcacggtgcctgtaattattaaacatgaattcaattaagctca

SEQ ID NO: 57376 - DNA, 276 bp, Homo sapiens
cgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcaggtatgctgaagaaagggttgagaatggcttgagttttcttattagggccagaggaggcagtatgattgcttcattctgttttccttgcag

SEQ ID NO: 57377 - DNA, 530 bp, Homo sapiens
catcccaggacccagtagtggtttttacattttaaagttgcgaaaaatcaaaaagtgaatggtaatttatgctgtggaaattaaataaaatgtaaatgtcagtgtccatgaagttttattggaacacagtcacagcatgcctttatcatctacagctggtttcatgctactgtggcagaattgagtagttgcaatagagactggccctttattaaaaaagattttctgacccctggactgggccattcactacctgtttggttgcatatggtggtgctggccaagggactcagccgggttggacctatgattctactccccttttcttcttcagcctggctccatcgattctaacaaccagctctttgcacctggagggcgactgagctggggcaagggcagcagcggaggctcaggagccaagccctcagacgcaggtatggaggcagtgtcaggagctgggtggttacccgtcagagctcccttgaggacagagccttttctgttagggaggccttcagtacaaggtg

SEQ ID NO: 57378 - DNA, 4818 bp, Homo sapiens
gtgctcgcttcggcagcacatatactaaaatggaacgatacagagaagattagcatggcccctgcgcaaggatgacacgcaaattcgtgaagcgttccatattttatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57379 - DNA, 4676 bp, Homo sapiens
aaagaagggttgtgggactcttcagtgcaaacttggtaaccctttgtgtcctgcagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57380 - DNA, 4247 bp, Homo sapiens
tagctaggtagagctggggttaatcggcagaggaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57381 - DNA, 4198 bp, Homo sapiens
  misc_feature (42)..(42): n is a, c, g, or t
  misc_feature (46)..(46): n is a, c, g, or t
  misc_feature (164)..(164): n is a, c, g, or t
cgtcaaagaaatccccagcagcttgggaggctgttctaaggncacnacaagggcctggagggcgtagagcgcctgtagctccttctgctcgtcacacaggtatttctgcagcagcttcgctcgcgctttcagcactgcaacgtccactcggaggggagtctcanaaataattgcagaatagcagacagccgtcatgagggctcgaactaacgtgttggatactatctgctgctcactcaggttggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57382 - DNA, 3656 bp, Homo sapiens
ctgacctgtaggaggctgattttccacctctggtactgccgggttcgcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57383 - DNA, 5257 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagagaatctggggatcatttgtttctcccatacagccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57384 - DNA, 2981 bp, Homo sapiens
ttttttttccttttaatggacttttctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57385 - DNA, 2902 bp, Homo sapiens
gcggccgctccaacatcagaaatggccttctcaaaaatgggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57386 - DNA, 4969 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcgccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57387 - DNA, 4936 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggg

SEQ ID NO: 57388 - DNA, 2769 bp, Homo sapiens
gtgaggtactctagaggacccgtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57389 - DNA, 4960 bp, Homo sapiens
ccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcagtggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttgggtactacgttggcagtgggatcctc

SEQ ID NO: 57390 - DNA, 2426 bp, Homo sapiens
gggagatctgaaggggcggggttagagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 57391 - DNA, 285 bp, Homo sapiens
ctgctggtgcctcaagggctttgtggggccaagagtggactccaggctccactcacctaacttctcaaaagggatgaaaactcgctcatttctggtgatggagtagggtctgctttagtttttcattgctgctgcaacaaatgaccttaaacttgtgacttgaaacaacccaaatgtatcatcttacaattctcactgggctggaatcaagtggaaggctgccttccttcaggaagctccaagggagaatccatctcttttgtttttttacagcttctagcggca

SEQ ID NO: 57392 - DNA, 382 bp, Homo sapiens
ctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccct

SEQ ID NO: 57393 - DNA, 395 bp, Homo sapiens
gaaaatctgtaggctgtagctaaacccaagtgcagtgacatttcagaaacttgccccgtttctaagagctggaacatttttacccagctacatgtccaagactcccttgtaactaaatgtagtcgtaatactaagtcctaactgatgggatacaagtggtagtacaagtattatgctagaaagtcttttttaaaaggaataagtctacagttattctctgccccttcctccattctgatgcctggaatgcagatggaatggctggagctctagcagtcaacttagatcacgaggatgacacaggatcaccttttagggaagactgagtgaaaactcaggaaggagcctaagttttttgtggtctatggagccactctgccagccctgaactgctt

SEQ ID NO: 57394 - DNA, 278 bp, Homo sapiens
ccgctgctccaggagccagcccccaagccaggtggacacagtacaactgcaaacacaagagcaggggccctgtctcctggagctcccggactgccctgacccccaaaggccagctcctcccttgcaccagcagtctctctgtcccctgtgagcccctacctctccgggtctcagctttcagtcttagggaaaaaaaaaaaatctgtgttcatgggctcaggcttcctgcctttagccattcagagggttggggatgaaagacctttcacattaaaaaa

SEQ ID NO: 57395 - DNA, 259 bp, Homo sapiens
  misc_feature (1)..(1): n is a, c, g, or t
  misc_feature (124)..(124): n is a, c, g, or t
  misc_feature (220)..(220): n is a, c, g, or t
ntgctcagagaggcctcctaaaaccactggatagaatttcaataaacagagggagaggaagcgtagtccaggcaggggaatgacacgcaggacagtgaggaggctgtggccatccagttgccgnctttgttgagagcccacagcgaggcagttataacgcactacacacctggtacctccatatgtgcacctgacaacaacctggaggtattattattcntttttcacacacaaggaaactgaggctcaggaaagtaat

SEQ ID NO: 57396 - DNA, 370 bp, Homo sapiens
agtggcttacaaaacacaaatttattatcttaccattctgtgagtcaaaattccaaaataggtgtcactaggctaaaatgaaggactgcatttcttcctgcaggctccaggagagatctatgtcttactcttttcggcttctaaaggctgcccacattcctcgactagtggcgtccctccttcgtctctaaacccagcaacaacaggttgagtcctcatgtcacatctttcttacctttctgtcatctcatctcgctgactgctgctgggaaaaattctccacttttaagggctatcatgattagactatgcccactagataatacaagatctcagatccttaacttccatcacatctgcaaagtcgctt

SEQ ID NO: 57397 - DNA, 297 bp, Homo sapiens
tcagggggtgctccagaaatcccgcccagtttccaaaagggtgagactgatgggctgaattgggatcctccctccccaattcgtatgttgaagtcttaagccccggaacctcagaatgtgactgtggttagagataaggtctttaaagagacaattacatttaaataaggttttagggtgggtcctaatccaataggactgatcttttttttttttttttttttttttttttgagatggagtcttgctttgtctcccaggctggagtgcagtggcacaatctcagctcactgcaacc

SEQ ID NO: 57398 - DNA, 349 bp, Homo sapiens
gtatttctttctgggtactcttcatggcctgctagagaactttactaaattatagtccagtagctggacagagctgcatgtgtattgtctaagtccacctgtgctgctggtcaagattattttgcagtgtttggtggtgttgaagaggaatactgttgtgaaggctgagtcaactgcatgacaattctcatggctcactggctgatgagttgtggcatgactagaaagctctgcttgtattcccagatgacaagtcacacctgaacagctggatactactcgcatccaatttgcttccaagttaacatattttcagaaaatatttgatttggagtacatacaaatattt

SEQ ID NO: 57399 - DNA, 428 bp, Homo sapiens
aaaaatgtctccctcctggcaaagggagatcacagagaaatttgttccttttcatcacagctccaggtgggggaataaagataccacctgaaaacttgaaactggagggtctgccatcactcattcaaggttcaaatttacatatctacatgatctaaaaaaccagaagccaagaaattaacataaagttggcccgggttggtaatgtgccatactgtctggaaaaaacaaatacggatcctctctgtaatgactcacccttagttaagccttttaaaatactcccagattttaagattgtccaatataggctcagagtcaaaaactgtaaaacatatgtgtaagggacagctaaactgacatagactcctaaggacttataggaatgatcagaaacaaattaacatttaaagagatgaaaaatgaaa

SEQ ID NO: 57400 - DNA, 651 bp, Homo sapiens
gagatggagtcttgctctgtcacccaggctagagtgcagtggcgagatctcggcttactgcaacctccgcctcctgggttcaagtgattcccctgcctcagcctcccaagtagctgggattacaggcgcctgccaccgcacccagctaatttttgtatttttagtagagacggggctttatcatcttggccaggctggcctccaactcctgaccatgtgattcacctgcctccacctcccaaagtgctggaattacaggtgtgagtcaccacacccggccggattctgttagttttctttaatgcatattgagtttctttagttttaacaggcacttatcttggttggacccaaactattcactatgtttcttgggtgacagcttgaatcttgggtggcagccattttgttaatagccaggttgctttgtgtgtattccatgcatgggtggatcaggggtcagccacatgtggggagagttggagataccctctttcctttctttccagtgggcatggtttcccagatttagtcttctggcttgcagaccggaaagactgcatttccccctcagcaccccaagctaaaggccatgaaaccatgaactcgttgtgtacagctctcctcctccaagtgtggactccccatgtg

SEQ ID NO: 57401 - DNA, 200 bp, Homo sapiens
acttcctctctcctggcatctgctataaaaataagaaggagcaaatattcttgcctctttttatcacctgatctgaaaacccattgtaactgccatgaaaataagcactggtccatgagaccaatgcccagaaaattcaggctaagattcctggaaagtgggctgtgggcattatttaaaacacacacacaaaatttacc

SEQ ID NO: 57402 - DNA, 245 bp, Homo sapiens
gttattcataccacagcatttaaaaagcaatccgcaagtgataaaaaaaaaaaaaaaaaatgatgtgacatatccattgcctgaattgctcttttgtaagccagtgttgggattatagcagaggagtagcagaaataaatatattcagacacaaacatatagatataataatatccaaccactttatatgatttagggtctcgttaaaatggttaccatttgcttctcctaaaaattatataaat

SEQ ID NO: 57403 - DNA, 377 bp, Homo sapiens
aggctgcagtcagcacagctaaagtcctggctctgctgtggccttagtgggggcccaggtccctctccagccccagtctcctccttctgtccaatgagaaagctgggatcaggggtccctgaggcccctgtccactctgcatgcctcgatggtgaagctctgttggtatggcagaggggaggctgctcaggcatctgcatttcccctgccaatctagaggatgaggaaagctctcaggaatagtaagcagaatgtttgccctggatgaataactgagctgccaattaacaaggggcagggagccttagacagaaggtaccaaatatgcctgatgctccaacattttatttgtaatatccaagacaccctcaaataaa

SEQ ID NO: 57404 - DNA, 416 bp, Homo sapiens
ttaattgcttagaaaaccaagtaatggcatccatctgatttcaaacagccctgacccataagttctttccttggctcatgtcattgtcaatctgtgacacaaaaaatatatttctataaaaagtaatgagagccagagaggacaggaaagtaaattaaagccactgcaaagctcctcaccaattttttgttgttgttctggcattaagtagttattccctttgcccttccctgccttcttccttttctctcttaaatccctccattccatacctctcttcttcactttcaaaccactcagtcagttgaaaccttggcacttaaaatatttctacaggaggaagaggaaaggggcagaagatgtctactgggatcttcatcccttcccaggcctggttctgggcattgtcaggtacc

SEQ ID NO: 57405 - DNA, 484 bp, Homo sapiens
ccgcctcggcctcccaaagtgctgggattacagccgtgatccaccgcgcccggctgtcccagaagctgttgactggaatccctgaggcccctacctgggcccacattggctgggcttcaatttcttccccaacaacctcctgctggtggccccagcccagccccttccccagcaggtcagggctcctctggggggctggtcccttcactgctctggcccaggaaactgaccccaagtcggaggcttctttgggaaccccgttctgtacccagtgagaggagagccagggccaggaggaagcgactctgagtgggagggaaatttctccacccatattgcttccctggtcctgggtcaaatggcaagttaaattagccattaaatctggggttgggcctggcacagtgggggctaaggcgggagtgttgcttgagaccaggaatttgagaccagtctgagcaacgtgacaaaaccagtctctaca

SEQ ID NO: 57406 - DNA, 377 bp, Homo sapiens
gacagaaaatcctaatgatgagcagtaagtgtcataataaagataagccaagccaaaaggcttagccaagcctggtagcttcctggaggaggtgatgtgtgaagtttgcactagtaggaggtggcatcaacaggcccatggggtgagtgttgaaagttcagaaagctggggatggagggagtttggagcattctctttctccttttcatctatctctgtccacttcctctttccctttccctgcttctcttttcccagcttcccctcagtttgccaggccctctcattccaatctctgttcccagttttggcccactgctcaccaaagctaggtccctaataactgtgggtccctatatttatagattccaaaggaa

SEQ ID NO: 57407 - DNA, 964 bp, Homo sapiens
  misc_feature (50)..(51): n is a, c, g, or t
cggaggtgctcatcgctgctgtcatggttagtttgctaaactgcgtcgtnnctgtgtcccagaacatgggcatcggcaagaacgaggacctgccctggccaccgctcaggaatgaattcaggtatttccagagagtgaccacaacctcctcagtagaaggtaaacagaatttggtgattatgggtaggaagatctggttctccattcctgagaagaatcgacctttaaagaatagaattaatttagttctcaggagggaccacaagaacctccacaaggagatcaatttcttgcaagaagtctggatgatgccttaaaacttaataaccagaattagcaaataaagtagacgtgatttggatagttggtggtagttctattttataaggaatccatgaatcactcaagcagtcttaaactatttgtcacaaggatcatacaggactttgaaagtgacacgttttttccagaaattgatttggagaaatataaatttctgccagaatacccaggtgttttctttgatgtccaggaggagaaaggcattaagtacaaatttgaagtacatgagaagaatgattaatatgaaggtgttttctggtttaagttgttccccctccctctgaaaaaagtaggtatttttaaattagaaaaaaaatacttatgttgactttaaatctacggataattatttctaagcaatgtgttcttattccccagtaacctacactatatctgataccatttatgaaacattcttgctgtaactaagtgcctccccaagaccctgactgagtccccagcatgtgctacagtgagctgccattccacaaccttcacatgtggcactcttgccagtccttgacattttcgggcttttcaaatgtcggtagtgtttattaaagatgaagatgcacatacccttccactgagcagtttcactagtgggaaataccaaaaactt

SEQ ID NO: 57408 - DNA, 4161 bp, Homo sapiens
tgagagtggaggggattcaagggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggaccttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattgaggctctctgaggaagtgtgtgcttataggagcagtggtct

SEQ ID NO: 57409 - DNA, 2157 bp, Homo sapiens
  misc_feature (1534)..(1534): n is a, c, g, or t
  misc_feature (1757)..(1757): n is a, c, g, or t
ccagaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccaggtgagtgtggcgggtggggggcgctgggtgacctcaatccacccatcttctccgttttcagtgctaacaactttcaggggctaccttttcaaaaatggagttaatgtttgggatatctggtttctgtatgtcgggatttgaagggagtcagggtggaggagatctatagatgcctggaccttgatattgcagttgctgggcaggttaaagatggagatggtctgggcgggggtggagctgggccccaagggctttctccttaggctacctgtctcccacagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggtgcagggcctgggggagtggacctctgggctgtgaggggacaggagagaggcaggggggaactaaagcccagcaaactacaatccccaacaggcactgggctctttgcttccccaccagctgctgctctggtgctgaagagagttgcagtttttatagtaaccntccctgctggggctggagtcgggagtcctggctggggatcctggagtttttttttctcttcactctggcttctctctccaggggacagtcctgatgaagctcctcagaatactcctccagcaactgtggaggggaggtactgaacacccccacccctactccctggttctctccccaccatgcttctacctgagggcagactaaccttcagctccagctaaancccacctccacaaaggtgaggggacaagggccagggctctagagataagcagcccttgtttcgaatcccagctctggcccttatcaattctgtgatcttatagaaggccgggcacggtggcttacatctgtaatcccagcactctgggaggccgcggcagaaggatcacctgaagtcaggagttcaagatcagcctggctaacgtggtgaaaccctgtctctactaaaaatacaaaaattagccgggcatggtgacgggtgcctgtaatcccagctactcgggaggctgaggcaggagaatggcttggacccagggagatggaggttgcagggagccaagagcgtgccactgcactccagcctggtcgacaagagagaaactccatctcaaaaaaaaaaa

SEQ ID NO: 57410 - DNA, 804 bp, Homo sapiens
tccacctgcctcggtcacccagaatgctggcattacaggcgtgagccactgcacccggcctaagacactctcttctatagcaaagcagagagtcctttctaaccaggtctcccaatatggggatctttagagcactggggttgggctgcatgggtcaggcataggggaggagggcccagggtcctagcttcccacggtgaactgggcttcccacgactgcctgcttttctttctagagtcttttcgaggtggtgacgtccgaggcttcctacctgcgctccctgcggctgctgaccgacacttctcaaagctctagcattataggtgtgagctactgagcccagtgaatgaggggatctttatgtgaagagttcccaactagattatcagtgtctttatgatcttattcagctttatctatccccattgtagacaacaaaataataataatgatactaatcaaaatagctcaacagctattaagctttctaggaatggttctaagtgctatacacctgtgtaaccttacctgcaactatgtgagggtaggaactattacttgtcctactttagacatgagaaagctaaggcacaggtcacataacttgcctcaggtcatacagaaataattgatggagacaaaattgtaatctaagcactcttagctactctgctatattgcctgcactaacagttttggttaataattattaaaataataggaaccttcggggcaggcacggtggctcatgcctgtaatcccagcactttgggaggccgaggcgggtggatcatctgaggtca

SEQ ID NO: 57411 - DNA, 692 bp, Homo sapiens
  misc_feature (380)..(380): n is a, c, g, or t
ctcaaaaaaaaataaaaatctgtagcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggaggtactgaacacccccacccctactccctggttctctccccaccatgcttctacctgagggcagactaaccttcagctccagctaaancccacctccacaaagaaggccgggcacggtggcttacatctgtaatcccagcactctgggaggccgcggcagaaggatcacctgaagtcaggagttcaagatcagcctggctaacgtggtgaaaccctgtctctactaaaaatacaaaaattagccgggcatggtgacgggtgcctgtaatcccagctactcgggaggctgaggcaggagaatggcttggacccagggagatggaggttgcagggagccaagagcgtgccactgcactccagcctggtcgacaagagagaaactccatctcaaaaaaaaaaa

SEQ ID NO: 57412 - DNA, 381 bp, Homo sapiens
gtccagcgggacccctgctgtccttctgaacgacctcatccctgggcagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctgtgagttgtgtttccctcagaaaacaaccttgggacacttatctgacctctcagacctcccccacttccccagtctctctcttctgtggctcctgcctcagccccagaggatcttttgggccaactgtgacacttcctatatctacgcgaacattttgttgctaaagtttgtgtttcag

SEQ ID NO: 57413 - DNA, 4662 bp, Homo sapiens
ccagaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccaggtgagtgtggcgggtggggggcgctgggtgacctcaatccacccatcttctccgttttcagtgctaacaactttcaggggctaccttttcaaaaatggagttaatgtttgggatatctggtttctgtatgtcgggatttgaagggagtcagggtggaggagatctatagatgcctggaccttgatattgcagttgctgggcaggttaaagatggagatggtctgggcgggggtggagctgggccccaagggctttctccttaggctacctgtctcccacagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctgtgagttgtgtttccctcagaaaacaaccttgggacacttatctgacctctcagacctcccccacttccccagtctctctcttctgtggctcctgcctcagccccagaggatcttttgggccaactgtgacacttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggaccttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattgaggctctctgaggaagtgtgtgcttataggagcagtggtct

SEQ ID NO: 57414 - DNA, 547 bp, Homo sapiens
ctactactactaaattaacggccggtcgactttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattgaggctctctgaggaagtgtgtgcttataggagcagtggtct

SEQ ID NO: 57415 - DNA, 4592 bp, Homo sapiens
ccagaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccaggtgagtgtggcgggtggggggcgctgggtgacctcaatccacccatcttctccgttttcagtgctaacaactttcaggggctaccttttcaaaaatggagttaatgtttgggatatctggtttctgtatgtcgggatttgaagggagtcagggtggaggagatctatagatgcctggaccttgatattgcagttgctgggcaggttaaagatggagatggtctgggcgggggtggagctgggccccaagggctttctccttaggctacctgtctcccacagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctgtgagttgtgtttccctcagaaaacaaccttgggacacttatctgacctctcagacctcccccacttccccagtctctctcttctgtggctcctgcctcagccccagaggatcttttgggccaactgtgacacttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggaccttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattgaggctctctgaggaagtgtgtgcttataggagcagtggtct

SEQ ID NO: 57416 - DNA, 1594 bp, Homo sapiens
ccagaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccagcctagaatgtcctcccttcggaatcatctcagtaccggagacactcctgttcatcagtaaccatggtggtgtccgaggtacacacattgggggtccctacagaagtgatatcatttatcagacagaggacgctagtaatccagaataataccaaatagaatgcaccaaccactcaaactgatcgcatagccacgcctagtccgataaccatgagagacagcacgccacaaagcactgaaatcactcaatagaaaagaacacacaacgttacccacaagtaacaggataacaacaacagataaagagatataattagaaagaacacacagcagtagaaaaagaaacaagcacaaacaacaaagacagagagaaatcaaaagcagaggaggacgcctggcaggcgcgaacatagaaacacggggcacagagcgcgcgggaggaggagaccgtaccagggatcatgacccgatgcaggagggagacgatacaccatgtcgacagcagcagacaagcggaccgcgaccgcaccgtgacggcacaacagccagcgctgccgcggcagaggaggggcagcgcaacgtaacccgcgcattgacgacgtgtagtgcggcgccggcgcgacaggcccgacaacctccacagaggaacgatccaggacgcagatatagacgggcacgccggcctcacccaacccagcgagggagcacaggagcaccacacctagagccgaaccccagacaggccacctacaccaacgatcacagagcgagacggcccagagacaggcacgccgacccagaccaccccgaccaaccgagcccaacagccacagaccgaaccgccatgtagccgaccctccagacaccacgcccgcgcgacagacaccgcaccacacaagcaccacagaacgaatgagcacaaagccatgccacaccaagacacgacataccagcaagacgaagacgacaggagtaagctgcaccaggcaacagatatcagataatgcctacgacaaacacgacggacaggaaccggagacagcagcacgaaagcggtcaccataggacctgagcacgaggcggagcgacgaacgcaccgacacaagcagcgaaagcactgcggcgacggagagcagaggtcactcgacaccgagcgagcgacaacgcagcacacaacgaccaccagcgcacgacagacgccagacacccacaaacccacaaacagacagaacgagcgacagacccagacggacgacgacagcagcgcacacgcaaagagacaggacggagacaacacgcgacaccgcgacgcaccagagacacgggaggcagacaggggaagcaagagcgacaagccgacacagcacagagcgaccggcgacaaacgacccaagcaacgcgcg

SEQ ID NO: 57417 - DNA, 489 bp, Homo sapiens
gtggccctggggacttccttccctttctttctccacagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtcagtggctttccgtcct

SEQ ID NO: 57418 - DNA, 4636 bp, Homo sapiens
ccagaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccaggtgagtgtggcgggtggggggcgctgggtgacctcaatccacccatcttctccgttttcagtgctaacaactttcaggggctaccttttcaaaaatggagttaatgtttgggatatctggtttctgtatgtcgggatttgaagggagtcagggtggaggagatctatagatgcctggaccttgatattgcagttgctgggcaggttaaagatggagatggtctgggcgggggtggagctgggccccaagggctttctccttaggctacctgtctcccacagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctgtgagttgtgtttccctcagaaaacaaccttgggacacttatctgacctctcagacctcccccacttccccagtctctctcttctgtggctcctgcctcagccccagaggatcttttgggccaactgtgacacttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggaccttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgatttgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattgaggctctctgaggaagtgtgtgcttataggagcagtggtct

SEQ ID NO: 57419 - DNA, 4617 bp, Homo sapiens
ccagaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccaggtgagtgtggcgggtggggggcgctgggtgacctcaatccacccatcttctccgttttcagtgctaacaactttcaggggctaccttttcaaaaatggagttaatgtttgggatatctggtttctgtatgtcgggatttgaagggagtcagggtggaggagatctatagatgcctggaccttgatattgcagttgctgggcaggttaaagatggagatggtctgggcgggggtggagctgggccccaagggctttctccttaggctacctgtctcccacagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctgtgagttgtgtttccctcagaaaacaaccttgggacacttatctgacctctcagacctcccccacttccccagtctctctcttctgtggctcctgcctcagccccagaggatcttttgggccaactgtgacacttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggaccttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcaccactatttactgaggttccccacacgtcagacaccctgctaggggagtccccaatgtcatgggactgccaaatgccagtgctcttcgg

SEQ ID NO: 57420 - DNA, 4741 bp, Homo sapiens
cgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggatcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggcgtgcagtatggtgaatatgttaataaccaagctagctccgcaccaactcccttgtcatcaacttccgatgatgaggaagaggaggaggaggatgaggaagcaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttga

SEQ ID NO: 57421 - DNA, 582 bp, Homo sapiens
tcccccttcatttcacagggctctagaagaaacataaagccgccacacaatactggtgacatgctaatcgttgtttatgttttattgacttaccaagaaaaatatagtcagttaaaatgtcagtgacatacttgtcattgcacatattttattgacttatccagaaaaatataaacagatttttcaacagtttaaattttatttgtgtagttgctgctgttgaggctaagaaatagagtgctggcagttgggggtgatggtaggaatcatgattttgttctattactgctgaagtctatgagaaaggaaagtttcctaattgtatttcttttaccagacacatcttccagagctagatacactttcatcagaaagagccagatccttcataacttggcttagagacagcagaccattaagtccaatccttcacatagtaaagtaagtacttttgtaacttaattatgaagttgtctttcctatgtagtctgtggaattgcttgtcttcaaagcaaactttaaatagtagcaaaatatattctgatggtaaaatgttgttacttgatttaaatcccctgtatt

SEQ ID NO: 57422 - DNA, 991 bp, Homo sapiens
tgggaggctgaggcaggagaatcacttgaacctaggagacagaagttgcagtgagctgtgatcacaccattgcactccagcctaagagacagagcaagactccgtctcaaaaaaaaaaaaaagaaagaaagaaagaaaaaaagtatttgacatgtttgctttgctttatttcctttttgatctaatgtattttcaatgactttttttttaggtgagcggagaattagagtacatacactttgtttgccagtggtaagttcactagcagatgtatatgcgggagtggatgtacaagctgccatctgccttctggcaaacatgggtgagtaaaaattgaaggaacatgtgaaatgtatttttctatcttaaaaactgaagcttggctggtggcagtgcgtccgcctgtaatcccagcattttgggaggctgaggcggacggaccacgaggtcaggagtttgagaccaggctggccaacatggtgaaaccccatctctactaaaaatacgaaaaaatagccgagcgtggtggcaggcgcctgtaatcgcagcttctcaggagactgagacaggagaattgcttgaacctgagaggcggacgttgcagtgagccgagaccgcatcactccaatcactccactccagcttgggcaacagagtgagactctgtctcaaaaaaaaaaagaaagaaagaaactgaagctaggattttctcttatttaaaaagcatatgttttacatttttatttactgcattgtgaatcagactgtcctcacatttcttccttaatcttactttcaaaatctttgagggaattcataatctctaaaaatgtggtaaaaactgaaatgtccttcaaataatatatgcacaatccatggtacactcatacaatagaatataatgcagcaataaaaaggaatgaactgtcaatacttaaacaaacatggatgcctctcaaagacattgtgctgaataaaagaagctagactc

SEQ ID NO: 57423 - DNA, 249 bp, Homo sapiens
tcagcggaccttacgcgcatcttcacatagtaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtaagggccagcagacgcgcgtaagggccagcag

SEQ ID NO: 57424 - DNA, 3573 bp, Homo sapiens
tcatcggtacctgtttgagcctgctgagcagagctattacaacaaaagcgtgcagtatggtgaatatgttaataaccaagctagctccgcaccaactcccttgtcatcaacttccgatgatgaggaagaggaggaggaggatgaggaagcaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttga

SEQ ID NO: 57425 - DNA, 2338 bp, Homo sapiens
aaaattgaggctgtgataactacttctagttaaatctaatataaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttga

SEQ ID NO: 57426 - DNA, 1335 bp, Homo sapiens
tcccccttcatttcacagggctctagaagaaacataaagccgccacacaatactggtgacatgctaatcgttgtttatgttttattgacttaccaagaaaaatatagtcagttaaaatgtcagtgacatacttgtcattgcacatattttattgacttatccagaaaaatataaacagatttttcaacagtttaaattttatttgtgtagttgctgctgttgaggctaagaaatagagtgctggcagttgggggtgatggtaggaatcatgattttgttctattactgctgaagtctatgagaaaggaaagtttcctaattgtatttcttttaccagacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttga

SEQ ID NO: 57427 - DNA, 3795 bp, Homo sapiens
cgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggatcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatgggtgagtaaaaattgaaggaacatgtgaaatgtatttttctatcttaaaaactgaagcttggctggtggcagtgcgtccgcctgtaatcccagcattttgggaggctgaggcggacggaccacgaggtcaggagtttgagaccaggctggccaacatggtgaaaccccatctctactaaaaatacgaaaaaatagccgagcgtggtggcaggcgcctgtaatcgcagcttctcaggagactgagacaggagaattgcttgaacctgagaggcggacgttgcagtgagccgagaccgcatcactccaatcactccactccagcttgggcaacagagtgagactctgtctcaaaaaaaaaaagaaagaaagaaactgaagctaggattttctcttatttaaaaagcatatgttttacatttttatttactgcattgtgaatcagactgtcctcacatttcttccttaatcttactttcaaaatctttgagggaattcataatctctaaaaatgtggtaaaaactgaaatgtccttcaaataatatatgcacaatccatggtacactcatacaatagaatataatgcagcaataaaaaggaatgaactgtcaatacttaaacaaacatggatgcctctcaaagacattgtgctgaataaaagaagctagactc

SEQ ID NO: 57428 - DNA, 1089 bp, Homo sapiens
  misc_feature (868)..(868): n is a, c, g, or t
  misc_feature (910)..(910): n is a, c, g, or t
  misc_feature (924)..(925): n is a, c, g, or t
  misc_feature (936)..(936): n is a, c, g, or t
  misc_feature (941)..(941): n is a, c, g, or t
  misc_feature (956)..(958): n is a, c, g, or t
  misc_feature (960)..(961): n is a, c, g, or t
  misc_feature (972)..(973): n is a, c, g, or t
  misc_feature (982)..(982): n is a, c, g, or t
  misc_feature (984)..(984): n is a, c, g, or t
  misc_feature (993)..(993): n is a, c, g, or t
cgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggatcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctgttaacagataagnttaacttgcatctgcagtattgcatgttagggataagtgctnatctttaagagctnnggagttcttanatatnaaccatggcactttnnncnngacccttcctnngggattcangnatgagaaanttttcattgagccttttaaaattgtacgactcgtccctgggctttagtgatgggatagacaacttattaaaggcattgcattcttaaataattctt

SEQ ID NO: 57429 - DNA, 471 bp, Homo sapiens
  misc_feature (452)..(452): n is a, c, g, or t
ccatgttggtcaggctgttctcaaactcctgacctcgtgatccgcccgccgcggccgcccaaagtgctgggattgcaggcgtgagccaccgccctgatctattttttaaggagggcttaagggattgatttttaccattaaatgttcgcagaactgttgctaaacctcgtgtaaatattgataatagatatttatttttaggtgtgtatatatgtgtttagttacaaattgtgtctctaaatttgtactgggacctcttatctagttcctgaagaatttatgtataacccccttacccgatcttatggagagcctcataaacgaccagaagttcagaattcaactgtggagttcattgcttcttcagattacatggtaactattcagtgttaagatttgttatggaacacaattacattggtcatttgtaattttctgttaagtgaactctnatcgagattttgaagtcac

SEQ ID NO: 57430 - DNA, 574 bp, Homo sapiens
tcccaaagtgctgggattacaggcatgagccaccatgtccagcctggctaaatgtttttagacttaagagattaaaacaaaaatgtccaaaagaatctagacttgttctgattgtcagatttatttcagaaaaaaatgtataagaagacatttgaaatgagggagctgatgaaatgcatttttccatcctaaaaacttagctgaattttgtttcttaaataatgcgtataaattttctctcttatagtgcccattggattctaatggttaaaatacctttcactttggttgctttttagctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacaggtagctttttacacattgctatatttaagagtgttttttaaaattctcagatatgtacatgaagaaaggaaatctaggttgttttctaatacttaacta

SEQ ID NO: 57431 - DNA, 4636 bp, Homo sapiens
cgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggatcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttga

SEQ ID NO: 57432 - DNA, 5385 bp, Homo sapiens
cgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggatcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttgacagtatggtttggtgattttttggggtttttgtttgattggttttttgtggggattggtgggtttttttacatacaggatgtattgaatttactaattggggaagtgcagtgatactgcatttcagttagtaatatatatgaatcaggccaggcgcggtggctcacgcctgtaatcccagcgctttgggaggccaaggtgggcagatgacttgaggtcaggtgttcatgacctgcctgaccaacatgatgaaaccccatctctgctaaaaataccaaaattagccaggggtgctggcgggcacctgtaatcccagctactcaggaggctgaagcagtagaatcgcttgaacctggaggctgaggttgcagtcagctaagatcacgccactgcactccagcctgggcaacagagtgagactccatcttaaaaaaaaaaaaaaagtaatatatatgaatcaatacactttcattagtctgtggacattaccaagtacttattctgtttgtattctaaaacaaagtggtgctactttcaaaaatattcttaactagtaagtataatcttaaattgtctttcttatttacattagatatttttgcctgcacacttatagcaagaaaattttagtaacacatatcactatcccatttatttaattgactttaagattgccatcttgaattttgaaagtgattttcttctgatcaagaaacctctcattcactaacaacttatttactataaaaa

SEQ ID NO: 57433 - DNA, 1375 bp, Homo sapiens
cgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggatcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggtgttgacagctcttctaccacaagcagtgcttctccaatgcccaacagttatgatgccctggaaggaggcagttacccagatatgctttcttcatcagcaagcagtcctgctcctgatccctaagccccaagtcaaaagaaatttagagctgatcctca

SEQ ID NO: 57434 - DNA, 1031 bp, Homo sapiens
  misc_feature (868)..(868): n is a, c, g, or t
  misc_feature (910)..(910): n is a, c, g, or t
  misc_feature (924)..(925): n is a, c, g, or t
  misc_feature (936)..(936): n is a, c, g, or t
  misc_feature (941)..(941): n is a, c, g, or t
  misc_feature (956)..(958): n is a, c, g, or t
  misc_feature (960)..(961): n is a, c, g, or t
  misc_feature (972)..(973): n is a, c, g, or t
  misc_feature (982)..(982): n is a, c, g, or t
  misc_feature (984)..(984): n is a, c, g, or t
  misc_feature (993)..(993): n is a, c, g, or t
cgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggatcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctgttaacagataagnttaacttgcatctgcagtattgcatgttagggataagtgctnatctttaagagctnnggagttcttanatatnaaccatggcactttnnncnngacccttcctnngggattcangnatgagaaantttcatcgagccttttattgctcttaaataattcttat

SEQ ID NO: 57435 - DNA, 300 bp, Homo sapiens
gaagggcatatttaatagctgctgcaaacatatggaatagtgctttaatcagtggtgaacaagaaattgctgttgttggttataaaaacaagggacattaatgttcttgttcttgtaccatagtaatgagaaaaaaaaatagtggttgaatggtgtttaatttgtacagtttgtgtcaaagtagaatgggcagatattttggtggataggcttttgtcttagttataaaaattaggacatttggtatgataaaggcagagaatcttaacaattggcactggcccagaaaattcagggtgc

SEQ ID NO: 57436 - DNA, 1363 bp, Homo sapiens
agttaggggcttcagcacccctctgtcagtagttaacagagccagcagacagaaaatcagtaaggttatagttgacctatgtaacaatgccatcaaacaactgaatctaatttacattcatagaatacttcatgaacaacagcagaatgcacattctttacaaattcacatggtctattcaccaagactatattctggactataaaagacatctcaagaaaattaaaatcatagacatcatataaaatatggtcttgattataatgaaattaaacttcaatggaattaaatttaataacataaagatagctgcaaatctctaaatatttggagaataaaaatacacttccaaataacacataagtcaaagcagaaatctcaagggaaatttaaattatttgtaactaaatgaaaatataacctatcaaaatgtgggatgcaatgaaatcactgcttcacagaaacttataacattgaatgcatagattagaaaagaaaaaagatttgaaatcaatagtcgaagcttccaccttagaaaactggagtaagaagtgcaatatcagcctaaaacaagcagaagaaagaaaataataaaacttagaccagaaatcagctacattgagaccaggaaaccagtagagaaaatcagcaaaactaaaatctggttctttaaaaatgtcaataaaattggtaaacctctaacctggctatcaagcaaaaagaagacatgaattattaatattggaaataaaagagaactcatcaggaatgctttcatagatgttaaaaggataataattaaagggataatagggttatgaaaagccctgtagccataaatttgaatacttggatgaaataaactaatttcttgaaggacacagactatcaagatttgtataaggagaaacagatattctgaatgggcctatatcaatgaaagaaattgactcaataattaataaccttccaaaaaagatagcatcaggcaccagtgtttgcactagtgaaatctaccaactcttaaagaaaaaaaatgataccaattctttgcaatctcttcctaaaaataaaagctgagctgacgttatgtctcatgactatgatctcagcactttgagaagccgcagcgggcggattgcttgagctcaggatttccagaccagcctgggcaacatgacaaaccctgtctctacaaaaaatacaaataattatctgagcatggaggcacatggctatagtcccagctacttgggaggctgaggtgggagaattacttcagcctgggagacagaggttgtagtgagcagagatctagccactgcactccagactaagtgacagagtgagacccaatctcaaa

SEQ ID NO: 57437 - DNA, 318 bp, Homo sapiens
aatgggcctgcctcccagagctggggattctatccaccctcaaagaggcagcagcagaggctgtgacccggagggaatattgtggtggtggaatggcacagtgccttccgtcccacaagcatgagtgagctgctactacgtgccaggcaccgtgtcaggtgctggagaccccacactacttgctgcctgggacccgggcacaggggttctagtccctgcactgccacttgctgactccgtggcatgaccaagtcccttcctttttgggcctcatgttcttcaaagtcaaggtgaagatttggactagatgagccctgt

SEQ ID NO: 57438 - DNA, 334 bp, Homo sapiens
acttatcatagacttacgcttcatccctttttttggtttggtttatttctgataagaaataaaagttaaaaaattattaaaataatcaaggctctctaattgatttaaaaatccattatctagtactttttagtgaatcaaaaagtcagaaagagtagaggaaaaaactaagactgtattgtactcacatatttcatctcgctgctttttttgtttgtttgtttgaaaagatcgaatgcttatcattagaaagggtcacacaggttctttatttctgcaatggaccgttagacaatttgatacatagctaagttgaagctttggcaaactaaag

SEQ ID NO: 57439 - DNA, 748 bp, Homo sapiens
gataggcgtcaatacatttaagaaaattgaaattatatcaagcactctctcagaccacagtggaataaaactggagatcaactccaaaaggaatcttctataccatgcaaatacgtggaaattaaataacctgctcctgaatgagcattgggtcaaaaatgaaatcaatatgaaaattaaaaaattcttcaaactaaacaacaataatgatacaacctatcaaaacctctgggatccagctaaggtggtgttaagaggaaagttcatagccctaaatgcctacatcaaaaaatctgaaagagcacaaacagacggtctaaggtcacacctcaaggaagaagagaaacaaaaacaaaccaaacccaaacccagcagaaaaaaggaaatagccaagatcggagcagaactaaatgaaattgaaacaacaacaacaacaaaaaccaaaagataaatgaaacagaaagttggttctttgaaaagacaaataaaattgatagaccattagcaacattaactaagaaaagaagagagaaaatccaaataacctcactaagaaacaaaacaggagatattacaactgacaccgctgaaatacaaaagatcattcaaaacttctatgaacacctttacacacatacactagaaaacctagaagagatggataaattactggaaaaagataaccctcctagcttaaatcaggaagaattagatactctgaacagaccaataacaagcagcgagattg

SEQ ID NO: 57440 - DNA, 1335 bp, Homo sapiens
ggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttaga

SEQ ID NO: 57441 - DNA, 1562 bp, Homo sapiens
ggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttaga

SEQ ID NO: 57442 - DNA, 398 bp, Homo sapiens
  misc_feature (11)..(11): n is a, c, g, or t
  misc_feature (14)..(15): n is a, c, g, or t
tctaaaatatntanntatatatatatttatgtatttaattttgctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttaga

SEQ ID NO: 57443 - DNA, 2667 bp, Homo sapiens
ggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagaga

SEQ ID NO: 57444 - DNA, 1538 bp, Homo sapiens
  misc_feature (11)..(11): n is a, c, g, or t
  misc_feature (14)..(15): n is a, c, g, or t
tctaaaatatntanntatatatatatttatgtatttaattttgctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagaga

SEQ ID NO: 57445 - DNA, 1321 bp, Homo sapiens
ggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgcctatctgaacatgggccgagctcgatgacgggt

SEQ ID NO: 57446 - DNA, 2702 bp, Homo sapiens
ggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagaga

SEQ ID NO: 57447 - DNA, 2647 bp, Homo sapiens
ggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagaga

SEQ ID NO: 57448 - DNA, 1370 bp, Homo sapiens
ggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttaga

SEQ ID NO: 57449 - DNA, 244 bp, Homo sapiens
ggaggaggcttggaggcatggagttgtggtggaagcaggttctgaaaagcagaactctgaagctggctcattctcacgaagtcatctggcccagcctcccgcctccaagcacatcctgcctgcagagggtctggctagctgccttttcagctctcgagggatagagattctacaacctccctctgtcatcagttccagagccactcccctttgcactagaagttctatgagggtgtgagggagg

SEQ ID NO: 57450 - DNA, 1084 bp, Homo sapiens
gtgaaaacataaacattcatagtgaagagtatacttatgctttgttaattcttcatgttccatagctttaaaaaaattgcaagaagtctgtgtatccctttttttctggccctacacttttcttctgccacccctatagaactgtcagcctgcacactgaaactgttctcagaaaacaaaggcatcatcaacttctcaaggttaaggtagtgatttaaggctaacagaccccacactcatgtgataataattagttaagcaattacaggtcacaagcagtcacttgtccagtgacattttaaatctctagtcatgactttgtcattggtttacttttgcccctgggaaaagttgaaaattccttagcatggaatcaaaactctcacatcagtgtggttcttgtcaggttattcagccttctctttcgccacttaccatactctgcacctttgttctatcatccagccaaactagactacatggagctccacagtgatcgtcttcacctccagctctttgcatttacttcttccctctatcctacatgtgttttccttccctttcagatatcaacctatgaattgcctctaccaaaaagcctacaatattgacacaaacctgggctagtatcccttctatgtcttctaataagtgctgtcttatgcctgtcactgtatgtatgactctgtatgggaattgcctgtttgttttttcagattatagcaaacagttgttgaggggtggaccatatcatctttatcttgtaattccagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaatatttttgtatcttttatgtctgatgaaaat

SEQ ID NO: 57451 - DNA, 635 bp, Homo sapiens
gtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaacttcaagaaacacaggatcaacttacagctactataagatgtactaaggggatggaaggcgacgcacaaaagcttgaagtagaaaatgccatgatgagaaaaactattaaaaaacaggatgaccaaattgagcgacttgagaaaatcctgcagcgttcaagtttgatgccacaggtgttcaagagctagatgaagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaatatttttgtatcttttatgtctgatgaaaat

SEQ ID NO: 57452 - DNA, 228 bp, Homo sapiens
gtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaagtaagtatcaagaaaaataagtatttttcaaacttcctgaagtaaaatttaaagtaatatttggttacagctgaatgttggatctagttgaatataaaa

SEQ ID NO: 57453 - DNA, 1197 bp, Homo sapiens
aagaatgttgtgtttcagtcctagagcaggggtcagtgaactttctgtaaagggccagatagtattatttaaggctttgtgaaccataagatccttgttgcaataactcagccctgtagttatagcacaaaagtagccattaacgatatgcagattgaaggggtgtagcagtgtcccactaaaattaattacaaaaaacaggtaatgggatgatttctcctacattatgaccttttttaaataaaaaagattgtgatagtctaaaatattttatatatattttgttgattcattcatctactgatggacatttaggtcatttctaaatgtaattttttttaattctttgttttagcttcaagaaacacaggatcaacttacagctactataagatgtactaaggggatggaaggcgacgcacaaaagtaaaatttgaagcagcgcacaaaataacttgagtatttataaagcaaaagagcactgtagtatgaaaattgtatcagttatgataataagtatgtctttgtgaagccaaaaaagtttcatttgtaagctgtattgaaatacatcatttttctacattattcctaaattttgcatattatcgacaaaacacagttagaaaaatgacacagtagcccaatcatctacttttgtgatcgctaagaatttgtgtaattataccttcagaagtttgtttagaatttacatgataaaaaaaattatgtgtgagagtaattattttaaaatgcacattttaggcttgaagtagaaaatgccatgatgagaaaaactattaaaaaacaggatgaccaaattgagcgacttgagaaaatcctgcagcgttcaagtttgatgccacaggtgttcaagagctagatgaagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaatatttttgtatcttttatgtctgatgaaaat

SEQ ID NO: 57454 - DNA, 1050 bp, Homo sapiens
aagaatgttgtgtttcagtcctagagcaggggtcagtgaactttctgtaaagggccagatagtattatttaaggctttgtgaaccataagatccttgttgcaataactcagccctgtagttatagcacaaaagtagccattaacgatatgcagattgaaggggtgtagcagtgtcccactaaaattaattacaaaaaacaggtaatgggatgatttctcctacattatgaccttttttaaataaaaaagattgtgatagtctaaaatattttatatatattttgttgattcattcatctactgatggacatttaggtcatttctaaatgtaattttttttaattctttgttttagcttcaagaaacacaggatcaacttacagctactataagatgtactaaggggatggaaggcgacgcacaaaagtaaaatttgaagcagcgcacaaaataacttgagtatttataaagcaaaagagcactgtagtatgaaaattgtatcagttatgataataagtatgtctttgtgaagccaaaaaagtttcatttgtaagctgtattgaaatacatcatttttctacattattcctaaattttgcatattatcgacaaaacacagttagaaaaatgacacagtagcccaatcatctacttttgtgatcgctaagaatttgtgtaattataccttcagaagtttgtttagaatttacatgataaaaaaaattatgtgtgagagtaattattttaaaatgcacattttaggcttgaagtagaaaatgccatgatgagaaaaactattaaaaaacaggatgaccaaattgagcgacttgagaaaatcctgcagcgttcaagtttgattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaa

SEQ ID NO: 57455 - DNA, 729 bp, Homo sapiens
  misc_feature (5)..(6): n is a, c, g, or t
  misc_feature (30)..(30): n is a, c, g, or t
gattnngcaggagacaaggtcagggtaatngccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaaggggggggggggggggggggg

SEQ ID NO: 57456 - DNA, 312 bp, Homo sapiens
ggcaaaggcttttctccgtaaataaacctgaagttgcttcttttagccactgaactcggcattgctcgtgggagttgggggctcagggagaagtggtgcctggagccagaacgactggctgtcactcttggactctgcaggtttggccctggagtgggctgtgttccctgggtcgggatgagtttgattttgtgccttccatttataacaggtctggctgcccttagtgaggggcttgggggtggagaagtctctgctcagaaatttgctttgctcactgtaaacctttgtgttttataccattaaaccaaa

SEQ ID NO: 57457 - DNA, 522 bp, Homo sapiens
ctatatataagatcatgtcatctgcaaataggaacaatttgatgtcctcctttccgatttgaatgccctttatttctttctcttgtctaattactcttgataggacttcacatttatatactttgaatatttaaaatgtttacataaatgtcagaatcaactttcatttttcatagaaaaagaagatcctacttgttttgtagttttaatattaatcaattattattatctgagacaaattattaacaaaccatctattaaaatatttcaccacaaataaattccataaggaaaatatctacaactgtttttatgaaagaaaaaaaggcttctctacagttgcttaggcctggtgccatggcacacacctataaatcccagcgctgtgggaggccatggcaagaggatcctttgagcccaggagtttgagaccagcatggacaacaaagtgagacctcatctctacaaaaaataaaaaagaaattagctggccatggtggtgcgtgcctgtggtcctagcta

SEQ ID NO: 57458 - DNA, 428 bp, Homo sapiens
cagcctgagtcaccccactccttcatgtcttctcccagagcaggttggaacctcatccacattggatttatcacttcctattgtaatcctttgtcaaccagccagtctctcccacaagagtcccaaaagttctcaaatgccagtgtgcacaaaatcacctgcagcatgataaacagcaggtcacctggttccacgaccaagattccaatctggggcccaggaatgaacattttcataaacataccaggtgatcttcatgcaggtgatcctggggccccacactagatctgctgctctcatgggttccaggcttggggaatcttgtcttcttcaggggtaggcgtccccagctccagctcagcgcccatcacatggaataataaatgagagaccttggctcacagcatggcttccccccttctgccagc

SEQ ID NO: 57459 - DNA, 257 bp, Homo sapiens
gatttaaaagcaagtgatttttaaatccacgaaagatgcctaccttggatcctgctctggtccttattagccacacctctcttgacaggcagaggagttaggagtgaggggatattcccaccaagaccctacaaattgcactcttaggccatgccctgggtacccaaactctagaattccctcctcaaagggaccttaacccaacttcagagcctatataggccaattccttggtccattttccaaggggtggccaa

SEQ ID NO: 57460 - DNA, 261 bp, Homo sapiens
cttcactataaatgggttaacacatttactcatacaatcacactttaagtgaaaactgctaacatctatagagagggatggttttggcactaaaaggccaatacacttactttaataaatgctcatctgtataattatacataataagtgttttggacaaagacttcaaagtcttttaagcatttatcataaacgatgtgaactagtacaagaaagaagacccctgggccccaccataccacaggcttaggcatcatccca

SEQ ID NO: 57461 - DNA, 769 bp, Homo sapiens
atctctagattacttataatacaatgaaaatgctatgtaaatagttgttatactgtatttagggaataatgataagaaaaaaagtcggtacatgttcagtacagatgcaactgtagttttcttttgaatattttttatctcaggacgaagccccaaatgcagaattcatagatacagagggccaactgttcttggaatttgggttgaaagctgttaaagttcttttcagccaaaaaaaaatgcctcgtaataaattgtcatgtttgaaatgtatcatgcttgttttgctctacatagttttttggtactacataactgtagacttaagtatctttttggtggaaataaaatatgaaatctctttaattttgttaatgttaggtctggtattcgttccattaagttccactttaaagtatggaaaaatgttataaacatctgctttaaacaatgaatggtactgcaatagtcctgtaaagaaaaatgaatggagtaaagtccttcaagttttcatttaaagaatggcatagctttataatacattaagtttttaatatgcggaatgtatttaatatcctaaagcgatgaattgtcttggcattatgctatcttatgaaacactttcttactctcacattgtgtctttatagttttcaatatcagcaaaacctttaaatagtcttagttgggtgttgtgtatcattgtacagcaactgttagtacatgtggtatttctgatccatgtaataaagtacatttgtcatgtaac

SEQ ID NO: 57462 - DNA, 517 bp, Homo sapiens
ttcacatctgttaggatggcatccgttaaaagataaaacaaaataacaagtgttgacaaagatagggagaaactggaacccttgtacactgtggtgggaatgtcaaatggtgcatctgctatggaaaacgttatggcggtttctcagaaagttaaagaatacaactatcgtatgttctagcagtcatgcttgtgggtatatacccaaaataatcaggaggaggatttacttgcacacccatgttcacagcagccttattcataacagccaaaaggtggaaggaaccaaaggctccatcagcaggtgaatggataaacaatgtggtatagacatactctgggatgttattctgccttaaaagggaaagaaatcctgtccattgctacatggatgtaccttggaggacatcatgttatatgaaataagctggtcacaaaaggacaaatacagttgatcctttgtatccgtgggctctgcatccatgagcttaaccaaccactgatggaaaatatttgga

SEQ ID NO: 57463 - DNA, 1272 bp, Homo sapiens
gcaaaagaatgcatgtgcagttgtccacaagccggcttcggactgcccctggtatgggagaccagagtggctgctatcggtgtgggaaagaagggcactggtccaaagcagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaataacattcaaagt

SEQ ID NO: 57464 - DNA, 1264 bp, Homo sapiens
gcaaaagaatgcatgtgcagttgtccacaagccggcttcggactgcccctggtatgggagaccagagtggctgctatcggtgtgggaaagaagggcactggtccaaagcagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaaacatttagaatagtgcattcgccatatatgacatctcagcatcttctgcttttcctggactccaaaattaaattgcagttcttgaaaatgtatgt

SEQ ID NO: 57465 - DNA, 788 bp, Homo sapiens
ggtggattcctatatatagctattgatagactcctaggtaattacatgggatatgagttagatccagtctgacttggtttgttttgttcttttttttccccccggaatacaggacaggacccagggcgcttgtacgcggagccaggctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaataacattcaaagt

SEQ ID NO: 57466 - DNA, 1001 bp, Homo sapiens
aaaaagcaaagccacagcaatttgctcttttatgtgaattgagaagcaaatgttatgaacctgtaataagttgtaccctatatgcatgtcagcaagacttgagatctcttgagaccaccatgcagctagtctgtgtttatgtgtgaagcaaatgatcttaaaatttatagtttgccattaatttttacttttaatgcagctggatctagcatggggtgggacatgcttccgaagtaagctggtataaatctatcagataacctgtctcttatgtttcaaagttaaatattaaattcatatattgtggtcttcaaaaggtattgctaggacattttaaaatgaattttgactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaaacatttagaatagtgcattcgccatatatgacatctcagcatcttctgcttttcctggactccaaaattaaattgcagttcttgaaaatgtatgt

SEQ ID NO: 57467 - DNA, 784 bp, Homo sapiens
gcaaaagaatgcatgtgcagttgtccacaagccggcttcggactgcccctggtatgggagaccagagtggctgctatcggtgtgggaaagaagggcactggtccaaagcagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtgagagatgggtgggaatggttaaaagattccatttagttcccttgaaagagacccatgcttcataaaagtggctagagccacctgtgctctccggacagtatcc

SEQ ID NO: 57468 - DNA, 1226 bp, Homo sapiens
gcaaaagaatgcatgtgcagttgtccacaagccggcttcggactgcccctggtatgggagaccagagtggctgctatcggtgtgggaaagaagggcactggtccaaagcagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttcccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaataacattcaaagt

SEQ ID NO: 57469 - DNA, 356 bp, Homo sapiens
ctgaggccaagagactggccaccagcataactcgggaggtcccagggcactgacttaagcctaggcatctggacagccagtttgcccacagccacctcattgcataagagctatgctctcgatgagaaatgtgcaccccagggagcagatatgggggtgtggctgagatttggcactggacttccaaagctgcaggaggtgtggctggcacctgtgggcccaggaccctccctgacacatgggaggcctgtctccagaggctccttattccctcttacaggccctaaaaataaagctaccaggacacagttattctggcctcagtgttaaacagagccctgggaaagaaaggggct

SEQ ID NO: 57470 - DNA, 264 bp, Homo sapiens
gctcaggcggtaatacgagtgacgaggagtagctgcagatacagatggagctcacctgccactcacctcctgctgtgcagcctggtccctaacaaaccacggacctatacttgtcgggtccatggccctggggttgggggcctctgatctcaagggtccttataagtaaaaagcggaactgagagagagaataaagaaagatttgaagattctagacagctggctttggagatgaagataggggaagccaaggaatgcaaatga

SEQ ID NO: 57471 - DNA, 433 bp, Homo sapiens
atccagtagagggcaggattcctagctggtcctcccctgttacctggttcccaaccattttgcttgagctaaatttgcaatgggtagcagcagcctaagccactggtatcacagctcccaccatgcttatgaatatgggcacaaggggcttcctgatgacttgtgagtacccggcaggatcaagccttgatgtcacattctatttgcatttatattagccggattcaactacatgcccttacccaataaaaagggtgggtgaggaagagaaaagcaatttaaaaggcgaggcttagccaggggtgagcatcaagtgcgaaacgctaattcgatgttcgtttggttgccattcctatgagcagctcactgtagcgtttgtgattatagtatttatatactgaacaagtactttttatatgaattgtgtaactgc

SEQ ID NO: 57472 - DNA, 2177 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57473 - DNA, 732 bp, Homo sapiens
gcaaaaagcaatctttatgaaagcttaaaaaaagcttttaataaaaggcgaccaacattgccctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57474 - DNA, 2506 bp, Homo sapiens
  misc_feature (18)..(19): n is a, c, g, or t
  misc_feature (21)..(21): n is a, c, g, or t
  misc_feature (2359)..(2359): n is a, c, g, or t
ggttggaagccccgcccnncngaggagtttcccaaaaccctgcgcggcggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaaaaaaaaaaaaaaaaaaaaaaaaaaatttttggggggctgggcccgaaaaagtttttaaaaccattaccgtgggggcgccggggccccatgtaggcgtaacggcgaaccatgggcgcaaacgcggtggccccatcaggaaagacccggggccacagacataggtcgctgggggtttctccccnccgatgaaaaaaaaacggccggggggggcagacccaaacgtgtccggaaaccaatcccacagagggagattccatgaggagccatacacagggggtccttccaaccacgggggctcccacgaggagcctcagcaatctcaacatacg

SEQ ID NO: 57475 - DNA, 2293 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagcatggggtttcaccatgttagccaggatggtctcaatctcctgacctcgtaatccgcctgccttagcctcccaaagtgctgggattataggtgtgagccaccacacccagccggaaatgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57476 - DNA, 2271 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaaggagcttttttccccctcgtgtttatcagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57477 - DNA, 1973 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagcgtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57478 - DNA, 2081 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagcattcgacacagagttgcagcctgtcaagaccttttggatcctgattcagccatccatcgttattagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57479 - DNA, 1076 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctattttt

SEQ ID NO: 57480 - DNA, 403 bp, Homo sapiens
cttgaacctgggaggcagaggttgcagtgagctgagattgtgccactgcactccacactgggcaacagagcaagactctgtctcgaaaagaaaaaaaaaatgaaattgcttttaacattctattacatgtcaccttcccatgtatataactctgtattgtctaataggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacg

SEQ ID NO: 57481 - DNA, 437 bp, Homo sapiens
tgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacattt

SEQ ID NO: 57482 - DNA, 1052 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctattttt

SEQ ID NO: 57483 - DNA, 2243 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57484 - DNA, 2205 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaaggagcttttttccccctcgtgtttatcagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 57485 - DNA, 450 bp, Homo sapiens
  misc_feature (18)..(19): n is a, c, g, or t
  misc_feature (21)..(21): n is a, c, g, or t
ggttggaagccccgcccnncngaggagtttcccaaaaccctgcgcggcggctttgaccgcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatgagaaattgataaaagaactcactcaaaaactagagcagaacaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaacaagaa

SEQ ID NO: 57486 - DNA, 294 bp, Homo sapiens
gcccaatttccttagcagggaagtttccaaacatttaaatatgcaaatgtataaaggcaaatgagatatcatttaatttgtttattgtcttacagtgaaagagagcaaatgagcaagttgatgcctttatggcaattatttttagtatgatttcttttgtgctaaggtgtagctgaaggcaaacctcaaattctagcatgaacatgcagcagcaataacatgaatattttaggggctatgcgattctttttgtgggttatggttggaaataaaattttaagttacaactccttt

SEQ ID NO: 57487 - DNA, 337 bp, Homo sapiens
tggaggcagaaaatgtttaacaaatttatgataaagcaattttttttctatcaatcaatccctagagggcattaactgctcttaggaagtttattgcagaagatgacacaaccgacgtgcacaaaaaaacagtaagcatgctgtgaagtggaggaggaaatggaacactctaacatcacatcccggccataccaaggtccattgaccctgtattctttccagataattaatttactacacattaaacctcgatgtgaagaaggctgttgtgcatcaattgtgtcggaataaaaagtgttattgatttaggatttctattgtatcatgtgctgacaga

SEQ ID NO: 57488 - DNA, 349 bp, Homo sapiens
ctatgtaaaggttgatttcttaactttattcatgttgaatttcatattattctatttaatttatctaaacaaatggattattttcctacagtactgaaatactacctcattgatttatttcattttctggttgttacctggtgattaatttctgtaaatcagcagaagtaataggactatactgtaatatcattgtactgtagtcatagatacttggaaagctgaggtaggaagatagcttgagctcaggagttggaggctggcttaggagttgaaggctgcagtgagctatgattgcgctactgcactccagcctgggcaacagggtgagaccttgtctcctaaggaa

SEQ ID NO: 57489 - DNA, 595 bp, Homo sapiens
cactaaagtactctcatagatgataaaaagtagtaactgaatatcacaaattttgggttatatttcaagggtgctaatttgccaattataaaatgggttcttcttcaaggaattttaaaaagtggaatgcaaacaggccagaaataaaatggtggtttgttctgtaaaagctgtgctatctgcactgggtaagcaaacttccaccagcacttcctgtctgaaacaaaagcagagctccacagtgtgcacataaatatcaaccccagacactacaaagagcaaacagcattttgatcaggaattttgatattaagactattttctgatgaaaaagggagcaacaacatcaagttaactgaaaaactattcaaattagtgtttgaaaaaagttaggctctagaccaagtggaaatattgcctttgatttcaacataaagtttactgcattcttattaagtatacagaattggaaaaggaggggaagtggcaggtggtatagacctcggaattctaaaccaccatcccttgcctgtaaggaagtcccacaatctagaatgtagcatttaccttctcttagaaattaaagagcaaaatt

SEQ ID NO: 57490 - DNA, 332 bp, Homo sapiens
ttttgagaataacattttgccataaattttatagatatttaccattaatccatttgtagtcctacaacatatagttgattacagttatacattttttgctgagtctttggttcaaagcatgcagttcccaattacaaagacattcctaatggaataaaacatccactttgtgactgatttaaggttgttttcttaaaggcacaccgcagccaaaagtgggacacagcttgaataggcaaattttttcctttttgttgttgttgcttcatccaataactgttaccaaattcccgtagaaaagtgttgcccactcccacatcgacctttggaag

SEQ ID NO: 57491 - DNA, 564 bp, Homo sapiens
taatgggtgcagcacaccaacatggcacatgtatacatatgttacaaacctgcacgttgtgcacatgtaccctaaaacttaaagtataaataataataaaataaaagattagtattttaaaagtaaaattaggttgctcgttaatgcatttttgtatttttttttttagctgttgtattttggcttgtttattcaagttttgaaattaggactgtggttaaacagcagaacttggctgtcaaagctcaaggccagttcagtctaaggctagtacctgttcatatatgtcattctgcagagctctccctctcatgctttagagttgggatatgtatatacttgctcacttgaatctctatgttagttagactcgacctccctttatgtagtatgcctaaagagcagactttctggctgggcgggcggctcacgcatgtaatcccagcactttgggaggccgaggcgtgcggatcacctgagatttggagtttgagaccagcctgaccacatgtaaaaactccttttctactaaaagtacaaaatgatctgggcatggtgacgagt

SEQ ID NO: 57492 - DNA, 360 bp, Homo sapiens
taaaataaatgctctggatgggagaaatgtggaagttactttggaactggataataagtaaaggctgaaagagtactgatatacatgctaaataaaaccaatatttccctgaatgaactattcaaagcaattctggtgggtgttagacaggacatagagacctggagaagaagctcccattttcataaagaacacaaacaatcatgtatagaatgttggtagaaatatgaatggtgaaggtcaatgtaatgaagtcttagatgggaataagaaaggttattagacaagggagaaaaggtaatccttgttataaagtggcaaagaacttggctgaattgtattcatgttctagtgctttct

SEQ ID NO: 57493 - DNA, 430 bp, Homo sapiens
gacctcttttatttaccagagccacagccctgctgcctcaggaccttttcattctgccggtgctggggctgtctatctgcaagctggaggtgttgagagcaggaaaaggaggctgtgaggaagggttcgggcagctcctcctgctctcagaggtggcctcctcctccaggcatggaggtctgtccactactgggcttctgggctatttgcccctgatttgctccctggtacgggctcttgttaacaggcaggcaaggggtgcggggaccaggcgagggcttcaaagggtacagtaccaaatcttccaaactcagcacttgtgccctggggtctccaaactgtcttctgccctaggatttattcatactgttaaattaccagtttatgcaaatgatatgtaaataaagctcaattttttgaaacttcatgc

SEQ ID NO: 57494 - DNA, 2121 bp, Homo sapiens
tcctgaatccattcaaggtagtaaagaaaaaggcatatggaagccagaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatacctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacaggttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccacaaaaaaaaaaaaaagcaatacaacaacaaaacatagtagcacgcactagcacaccgaacacagcgcaaacaaaccaaggggggggggcccccaaagaaaaatcccccgcgaagagcgccaacatcatcgactcgccccctttcgtctgcaacaagagggccccgcaagaagggaccgaccatataaaatcaacagcaccgcgggcacgtaaaacagcgcgtcggagagggaacaactcccccgcgtgcgacaccggggggagaaccccacactggggggggacac

SEQ ID NO: 57495 - DNA, 1084 bp, Homo sapiens
gggtctttggtggtttgccttgccatgtgtccttaaaaagtaccctttcctcccaacccctcttcagcaaccgtttttcttttttctttcctaaagatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacaggttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccacaaaaaaaaaaaaaagcaatacaacaacaaaacatagtagcacgcactagcacaccgaacacagcgcaaacaaaccaaggggggggggcccccaaagaaaaatcccccgcgaagagcgccaacatcatcgactcgccccctttcgtctgcaacaagagggccccgcaagaagggaccgaccatataaaatcaacagcaccgcgggcacgtaaaacagcgcgtcggagagggaacaactcccccgcgtgcgacaccggggggagaaccccacactggggggggacac

SEQ ID NO: 57496 - DNA, 929 bp, Homo sapiens
tcctgaatccattcaaggtagtaaagaaaaaggcatatggaagccagaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatacctttcctctcctggaagatgaggatgacctctttacagatcagaaagtcaagaagtataagcgttggagtacacctgccgtgtaatcct

SEQ ID NO: 57497 - DNA, 2046 bp, Homo sapiens
tcctgaatccattcaaggtagtaaagaaaaaggcatatggaagccagaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatacctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacaggttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccacaaaaaaaaaaaaaagcaatacaacaacaaaacatagtagcacgcactagcacaccgaacacagcgcaaacaaaccaaggggggggggcccccaaagaaaaatcccccgcgaagagcgccaacatcatcgactcgccccctttcgtctgcaacaagagggccccgcaagaagggaccgaccatataaaatcaacagcaccgcgggcacgtaaaacagcgcgtcggagagggaacaactcccccgcgtgcgacaccggggggagaaccccacactggggggggacac

SEQ ID NO: 57498 - DNA, 402 bp, Homo sapiens
ctggcctgagcatctctcctgcaccttcctgagagacagaccgagtgatcactgtgtgaattaaagcccatttcctagaaactcactcttctcttgaagcttttaggaagactaagagataaagccatccaccaagagataaagccaggaaaagtgtctgtcccagtgcaagtgtgtgagggttgttagtggtgggggatgggcatccttcattctttcagccaggggactgcacgtccgtggagtgaacaccccagaggtgggcagggaccaagtccagcatgggagacaggacccctgggtcaaaggctgttcttaggtaagcttcgtgacaaacatggcatttgagctgggtcttgagtggagccaggagaaaacaggaattttgaaaattcctgaggg

SEQ ID NO: 57499 - DNA, 445 bp, Homo sapiens
tggagcagtgttccacatgtgcttgaaaataatgtatattcaggtgttgtggatggagtattctactgatgtctgttagattagttgtttatagtattgttcaagtctcctgtttccttgttgatcttctgtctagttagtggttctatgcaatgttgaaagtgagttattggccaggccatggtgtctcatgcctataatcccagcacttagggaggccgagggggtgaatcatattagcccaagaatttgagaccagcctggccaacatggtgaaacccagtctctataaaacacacaaaaattagcttagcattgtggctcacgcctgtggtcccagctacttgggaggttgaggtgggaggattgcctgagcctgggaggttgaggcttcagtgagctgagattgtaccactgatctctagcctaggtgacagagagaccc

SEQ ID NO: 57500 - DNA, 302 bp, Homo sapiens
tcccattttctcattctctctcagctcatcttctgtctgtacttctagatctcattcgcccattcatttatccacagataacatatttttactaaattttaaggaggtgacagtaatttttataataagtgcagatcttaatagaaaagaacactaacatctaccagattataacctcagtttagaggctacgccctcagtatataaaacttgtgtgcatttaataattaggattcatgatccttttgagttaggactccaaatttctaattgctgggatgtgcatgtttaacattgtctgg

SEQ ID NO: 57501 - DNA, 404 bp, Homo sapiens
ctgcaagagaaaagcccaagggcctaggtaaacaatggacagcatcctggatgatgatgcaattttaagcctgaaaagaatatttggtcttcaatcttggcaagcatacctgtaaagtagatggtaaggctgctgatgagtatttttagaaaaaatgatcaatgagaaaattgcaccagaggacccacattgggacttttgagttgaacacattacttagcaaatgctaacatgggaacttgaggatatttagtgaacctgctgaagtcaacacattcatgcaactgaaaccaatagagaagaagctatctaaccttggcattttggggtctaaaaaaagcttttacccactattgtgctttgtaacctataaaataaatcaaaataaatcaaaacataacaac

SEQ ID NO: 57502 - DNA, 342 bp, Homo sapiens
cttcctaaagatcccttgaacataaccatttctctcctctccactgccatctctagaccaagccactatcatttgtcacttggacaattgctgcacattcctacctgagccacaacttattcccatgaaagtgaacaaatagtaatataatattttgaaaacatttactatgttttgctcactgattcattttttgttttccataatgacattagagatatacacattagccaggcacagtggctcacacctataatcctaagacttttgagaagccaaggagggtggatcgcttgagctcaggagttcgagaccagcctgggcaacatggcaaaaccctgt

SEQ ID NO: 57503 - DNA, 213 bp, Homo sapiens
tatctcccctatttctgaagacatatctacctcttttatgagaaaattaagattttgattttgtatattcagagaaatgttttgttttttacactgaagtgtcagaataaagggagctcccttaaaacagtgaaaatgattatttttataaatatgatctaaaatcaactattaccacgtgtatactgcacatacacagacacatacaaacac

SEQ ID NO: 57504 - DNA, 423 bp, Homo sapiens
tccttggtggggtcacctctgccggtctattaggaggacaagtctacatttacatacttttttatatatcaaaattcagcattttgttaaccaagaaagtaaaaaatctagccagatttgagaagtattagccttaaaatattatcttaaaaactaagaaatcccacttaattccctttgatgattctcctaaaacaaatttggtttcagattttttctaaataaatatatgaaaactatattcatattctttttgagaaggcctccaatatataaaatctttctgtgaaattgaactctcctggtgtaacaatgacagccctataatgatataattttaagggagaaaatcagaaataaaagattgataccttaagggaagactatgctggcataatcagattaaatgaggatccgattttc

SEQ ID NO: 57505 - DNA, 1305 bp, Homo sapiens
gtgtggggggcggggaggattctgagaccagccaggtaggagttgctgccgaaaaaggagcggaaattagcccaacctggcttccctacatcctggggaggaattagagagaacagagcccgagatgtagttgccagagaacaaattacttaaaatgagagcgtgctagggacagaaacccagtttggggctgactcatggtgagaaaacagttttgtccccctgggtgcctcccgaagaggaggtccagcccagtgtttgcttgcatgtggcgggaattttaatttattttttaaaatgttggtgccaggtacaggttgctaattagaaagcacaggcagtttttaaaaatgaccatctattgtcactgtcatctcaggggaatggaaaatatatgaatctttaaaaaataaaaagcagctatataatcttggaataaaagcctgtccttcccaagagaagacaggtttgcagcagtgcagggagcttcctccatggatcagtgagcactggttcacatggcgtgtttgagaactgctggcatacccctttgtcgtgatctgacgtgttagttcccagatgaggatgaatttgtgttgaccagtagctcttctctgtccttagactgaccagttgctcctcagcagctgggcatctcatgcgttggcctcagtggtcacatggtggggctcaggcctggcaagaggccgaggagcagccttgtaactgggtgggccatggggcttgcctggctggtagcactgggccacagcaggctgcgtggttgatgcagtgatgacccagggagaccctgggttggttttaagcttgattcaccacatggagtctccatgccttccattaaactgccccgccaagcctttccttctgctccctgggaaactggttggcctagaggtgctgtcttagcatctgtgacgttcagctgctgccccatctggagtgactggaaggacactctggggcaacactgagcgccaggctgccgaacagagagtgccatttgctctttcagcagacccctcacttcctgcagacaggccctgcctggcagtgggatatggtggggtccctcccctgcgtttgatctgagcttttctagctctccagcgagactctgcagggtgtgggcctggagtctggatgtggcccctccctggccttaggaagctcagaaggtggctgaggactccgaccggtaggaaagtataaagatgatgttacatccagggcacagaggccaacttgcacagagctgaggctgggggcgtgaatttggctatg

SEQ ID NO: 57506 - DNA, 460 bp, Homo sapiens
attctgagcatggccgtgcctactataataggtctcagcttatggaaagagttttttcccagattaatgacagaattaatggaactacaggaattctatgacccagatacagtggaacttatgacctggataaaaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctact

SEQ ID NO: 57507 - DNA, 162 bp, Homo sapiens
  misc_feature (126)..(126): n is a, c, g, or t
gctttactgacttggaatctatgaaacaggtaaagttgaagaacgcctttctcttctgtttcctccccatgctctaggagtctcaataaagaataatgaatcctgagctggcctttcaaaatgtgntcaaaaaaataaccgaactccaggggtcattagtcc

SEQ ID NO: 57508 - DNA, 481 bp, Homo sapiens
gtggcacatgcctgtaattttagctactcgggaggccaaggcaggagaatctcttgaaccaggaggtggaggttgcagtgagtcgagatcccaccattccactccagtctgggcgacagagactcaaaaaaaaaaaaaaaaaaagagcagagaaaatgataaacaacttgcaggttgttgtgtggtataatggtcattcattattttctactctttctggtaaagagttggtgtgtcatggaaagtacctgttctatgtgtgtgtgtctgtgtgtataattcggtgtgaaaattaaagagaaaaaaacaataaaaaaccctttcctatacttatgtgtaaattaccatggtgtgctgcaaaaaacatatgtcaaggtgatagaattattttgactttcctgtacagttataaaatgactcagtgagtttggttagatatcctcgttctttgaatctatatccttgtctgcttatgatgaaa

SEQ ID NO: 57509 - DNA, 252 bp, Homo sapiens
ttaaattttatatatttattgataaaacatgttattttgaaccatgtatacatttgtggaatggcttaacagggcaaattaacactgacaatggcatttaaaaaaatgacttttgctagccaagaaaacctcaaacaatactttctgtttcagatctctaaattcagttcatacgttttaaaggatgcttactgaatacatataatttatttccctggaaaaggtaacacgccattttctctgtcaaaaaaa

SEQ ID NO: 57510 - DNA, 205 bp, Homo sapiens
accagttaggaagcttctgcagttggagcatgatgactcagacaacggttgttcaagtggagacagtgtggaatggtgagatttggagtaaatttcgaaggtagagacaacaggatttactggtggagtgaatattgggtgtgtgaaaaaagaaaagtcaagaatgacttcaagattttaggcttaaacaactgttaggatggaa

SEQ ID NO: 57511 - DNA, 574 bp, Homo sapiens
attatgcctctctctgctcctggggctgtacaggacagagtaggagaggtgcaggccccatggaggccaaggaaaagcagactgagcatttccaaatggtggggccactggagatccacaaagtcactgctcagaggaggactcttgagtgatttctgcaattttcatgtaaatctgtagaaagcaaagtctatttctcttcagtaatgtttgaccaatcagacgctatccgcatagagacaggtcaaagaaacagccagaggggattgcttctctgaggtttgttactaaacaaatcttctctgattactaaacttctaaggcaattactctctttgctgccacaaatgctacattttctaattcttgtcttaaagtgtacaaaatgttacaaagagcagggttatctctctataccgcattgtcaatttaaagattgtctttttaagttgactgtttaatcatcagatgctattaagtggatctctgtttttatcctctgacggtacgaggatttattttcaactcttgccaagagtcttaggtaaaataaaataagtgtctgtcactcatt

SEQ ID NO: 57512 - DNA, 469 bp, Homo sapiens
tggttgtgctctgagagcttgaccttgctctggaatcctttatggtgattgtcaaactagcttaaatgaagtgggtggggacattctctttcctcccctctcccactcccctgcttagttaaatcaggtaaccttttcctatacttcttagggagacctcacgcttgaaacttgcctccattctgagctcctcaccgcttcctggctcaatctgtgtgtctgtctgtaatgcctaggagctggatctgtatggctgagtttggatgcgtgtccagttggcttgggagtggagaggggcaccatcacctgggtctgtgggttggaggatggtgacagatgaatttaatatggggtgctttgctttatttaacagacgttactgtggaaacacttggtgcaaatcgagtgttttgagcgtgttgttttaaaagactttaaaatgatttcaaacttacagaaaagttgtaaa

SEQ ID NO: 57513 - DNA, 1062 bp, Homo sapiens
atggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttgcgtcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcacggtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacacacaccacttctgcttcacctcctgaggagacggagttacaagcaatgtga

SEQ ID NO: 57514 - DNA, 389 bp, Homo sapiens
aatgctagttaatgccactagtgatgaatgagaacagatttggaccttgtctatcccttaaaccagtgtaaagtacagctgacccttgcacaacatgggggttagggatgccaactctctgtgcagtctaaaattagcataaaacgtttgattccccaaaaatcttaactactaatagcctattgttgaccagaagccttactgattacataaacagtcaatcaacacatattttgtatgttatgtgtatttatactgtattcttaagactaagctagagaaaaaaatttatgaaaatcataaaaaagaaaaaatatatttactgtattaaatggaagtggaccatcataaaggtcttcatcctcattgtctttactttgagtaggctg

SEQ ID NO: 57515 - DNA, 392 bp, Homo sapiens
gaagatttagccaagctcagtgactgccttagcagttatgagtcatattaataatgcctacatctgcctccaccaaaaggctctagggtctgtctccgaagtttattaaactcttccttgggagacttgtgcttgggacttagggttctaagtcttttctttcattatttttggctgtaactcacttttacgtggttgtggccctgggcaaaattttgaaataggtaacttccctttgcattctcccagtactataagactcatacgtcctgggttttaggggtgcaagccagtccttgcattttaccaggattcttgaaggctgcaaactcgggatgtaaacacaagccattactgggagagcatacttgagacattggaggcctcttaag

SEQ ID NO: 57516 - DNA, 230 bp, Homo sapiens
tctcttttactttccaaactattttatttaaaaaaaacctgcagtgcagtattaaaaagcaatacattcagcaggagtgacaaccaacagaaacaaagggaggagggtacagaataccagggaccctacctcaactgatccccaggtctggaggccaggggcagactgggaaggagcacgggtggtggggaagggagaaaagggcacccaccaaaaaggaaaaggcagaa

SEQ ID NO: 57517 - DNA, 2280 bp, Homo sapiens
aggattggggtggggttcatcccacccagaccacagagactgaaaataagaaaggggtgaggcctaagggacaatcaggatgtttttcagagagaagtgtggatgctggacaggaagaaccacagataccagatacgggacatactttattcagctgggtgctgaaaaagaatcttggaaattaggaaactgaatgaggcctcatttcacactcagaatgtgggttgcaatagtcacttcctctgctgctgggaaagaaagaattatactaccttttgaattttggattaaggagagaggtgttggcttgtcaaactaccatgtattcctcaagacatatttttgtggctttataaaattcaatatatatgtctaaattcaaaaatattttgttgcaatctggcccttggacaaactgaggccctagcaactgatgtttatggctttccgtagaacctttcagataaaatttacacagcattttactgcagctatttcacacaaagcagaggattttgccacaaaactgaaagaaaaaagaaactgcattcttaaatttttcataaatcaaaaggtataaaaatatctacctaaacgataaaggagatgagaaaccccacccatgatgggaagaaagcctatttcagttttgcctttacttcaagttcttttttccatatctggaatgcaatcagaattttaatcttgccttgggttcctcctggatttggggagaagacaaaacctgaaaatctctaatctgcatgtgttcagctgcgtatcttctggatacggaaggatcacactgcacagagtgctggacttgcaggagccccgcttctcaacctccatcgctttatgaatgaattcaccagaaagaaaaggaagaatcaacactttcagagatggagcctgttgagccacagtaccaactagtcaatgctgaatcgacttctccctttctacattgcctgagagaagtcattggggaatactctgtacacgaattttcactgttggggaaaacagagagtcaagggattggattgtggattgcattggtggttttcctcagtttcctcatcttctccacaagtttctacatatcgaatgcagagcagcccttcttcaaaggacctcctacggaagctgctaaggaactcagtctgtagctctgcgtggagccatgtgtaaacactgaactgagacctgccacctcctactacctaagggcccattttcatctgatatcatcccccagaaacaaactcatgatgacttccatgttttttttagattagatacatggagaattttcctttcccttagaattaaaatcctgcattctaaaaatcagtaagcttttttatttctgaataattttaaatttaaagagaagttgcaaagatagtatagaatgttcccttatacctgtttttatttagagtgatgttcccaggagaaatgataatgcagcaatggacaagaacaggaacaagagacagtcttaccatcttcttacaatttatagatgggacagtggaaagagaagccacatcggggttgggcatgcagagacctggtcctaaatctgtgtgacttttgcgaaatccttttgcctcacagagctctaggttcttatctgtcaaacaggaaccagaccatcagatccgtagagatccaaccaatgaaggagacttcgaaaacttcacattgccgtgtcaatgtgaggttgctggatggttatgacaagaaatcacattaaattcactggggtaacattgttcatgaaacgggataatgtgtttcagcgatgaaccacccatggccttactacagacatatttccactttgaaaatgtgtgtgagtgtacatgtctgtgtgtgaggcagagattagaaagtgtaaatgtgtgcgttttcattttacacatcttacattttcctttaatttgtttgaaagcctgttttgtttgtggcttccattcctggaagtcccatgagttgttagtggtgaagatggaacagatgtgtccaacccgggggactcctgccctcagggactgagcagctgcaaacctctctctcatctgattccactgtttcttccacatgtacacatcatgagaaatattgttcaatcaatatcttcccttaaatcaactcatatgcttatttacatgaatttacctaaaacagaaacttgatatcacttctgtaaatgaaaaaattaaactttctggctttaaataaagcataacaataataatcatgtcaaaa

SEQ ID NO: 57518 - DNA, 1914 bp, Homo sapiens
cggaagatggttccgaatcaactggataggatttttaatttccgaaggcacgagctcccctggcatccgcaaatgtgacccgcaatttagagaggaagaggagcgcagaccctacctgtccggagtaacggtcaggagagaggtggggaagggctgggcccctctcggtgtcccgggttcccggcagaagtctccagggctgaggcagtctgcagacacggagtttccgtgccagaggagagggtccacgcggacaggcagttccagctccgggtaagtgcggccccatctcctctccgtccccggctccgccagcagcagtcccggagagatttcccctccccgccgcccgcgctctctctcctcctgcgcccaggccggtctccggctccggagtcggacggcgacggtgcagatgagggcgcacaggggacggtcctggagcccgggaagggtgcgagatggagacggcggttcagaaaagttgtcaggtctccagcccgggcagtggcgggagctggagccgcggtggagacgactcgaggggacgcagcccgcctggcacaaagggccacgggcgcgagggactcgatgagctgggagatcgcggccccggcaggtgcggcgcgctggggcgggtgcttggcgccttccccggcacagagagtcaagggattggattgtggattgcattggtggttttcctcagtttcctcatcttctccacaagtttctacatatcgaatgcagagcagcccttcttcaaaggacctcctacggaagctgctaaggaactcagtctgtagctctgcgtggagccatgtgtaaacactgaactgagacctgccacctcctactacctaagggcccattttcatctgatatcatcccccagaaacaaactcatgatgacttccatgttttttttagattagatacatggagaattttcctttcccttagaattaaaatcctgcattctaaaaatcagtaagcttttttatttctgaataattttaaatttaaagagaagttgcaaagatagtatagaatgttcccttatacctgtttttatttagagtgatgttcccaggagaaatgataatgcagcaatggacaagaacaggaacaagagacagtcttaccatcttcttacaatttatagatgggacagtggaaagagaagccacatcggggttgggcatgcagagacctggtcctaaatctgtgtgacttttgcgaaatccttttgcctcacagagctctaggttcttatctgtcaaacaggaaccagaccatcagatccgtagagatccaaccaatgaaggagacttcgaaaacttcacattgccgtgtcaatgtgaggttgctggatggttatgacaagaaatcacattaaattcactggggtaacattgttcatgaaacgggataatgtgtttcagcgatgaaccacccatggccttactacagacatatttccactttgaaaatgtgtgtgagtgtacatgtctgtgtgtgaggcagagattagaaagtgtaaatgtgtgcgttttcattttacacatcttacattttcctttaatttgtttgaaagcctgttttgtttgtggcttccattcctggaagtcccatgagttgttagtggtgaagatggaacagatgtgtccaacccgggggactcctgccctcagggactgagcagctgcaaacctctctctcatctgattccactgtttcttccacatgtacacatcatgagaaatattgttcaatcaatatcttcccttaaatcaactcatatgcttatttacatgaatttacctaaaacagaaacttgatatcacttctgtaaatgaaaaaattaaactttctggctttaaataaagcataacaataataatcatgtcaaaa

SEQ ID NO: 57519 - DNA, 1349 bp, Homo sapiens
aggattggggtggggttcatcccacccagaccacagagactgaaaataagaaaggggtgaggcctaagggacaatcaggatgtttttcagagagaagtgtggatgctggacaggaagaaccacagataccagatacgggacatactttattcagctgggtgctgaaaaagaatcttggaaattaggaaactgaatgaggcctcatttcacactcagaatgtgggttgcaatagtcacttcctctgctgctgggaaagaaagaattatactaccttttgaattttggattaaggagagaggtgttggcttgtcaaactaccatgtattcctcaagacatatttttgtggctttataaaattcaatatatatgtctaaattcaaaaatattttgttgcaatctggcccttggacaaactgaggccctagcaactgatgtttatggctttccgtagaacctttcagataaaatttacacagcattttactgcagctatttcacacaaagcagaggattttgccacaaaactgaaagaaaaaagaaactgcattcttaaatttttcataaatcaaaaggtataaaaatatctacctaaacgataaaggagatgagaaaccccacccatgatgggaagaaagcctatttcagttttgcctttacttcaagttcttttttccatatctggaatgcaatcagaattttaatcttgccttgggttcctcctggatttggggagaagacaaaacctgaaaatctctaatctgcatgtgttcagctgcgtatcttctggatacggaaggatcacactgcacagagtgctggacttgcaggagccccgcttctcaacctccatcgctttatgaatgaattcaccagaaagaaaaggaagaatcaacactttcagagatggagcctgttgagccacagtaccaactagtcaatgctgaatcgacttctccctttctacattgcctgagagaagtcattggggaatactctgtacacgaattttcactgttggggaaaacagagagtcaagggattggattgtggattgcattggtggttttcctcagtttcctcatcttctccacaagtttctacatatcgaatgcagagcagcccttcttcaaaggacctcctacggaagctgctaaggaactcagtctgtagctctgcgtggagccatgtgtaaacactgaactgagacctgccacctcctactacctaagggcccattttcatctgatatcatcccccagaaacaaactcatgatgacttccatgttttttttagattagatacatggagaattttcctttcccttagaattaaaatcctgcattcta

SEQ ID NO: 57520 - DNA, 2415 bp, Homo sapiens
cggaagatggttccgaatcaactggataggatttttaatttccgaaggcacgagctcccctggcatccgcaaatgtgacccgcaatttagagaggaagaggagcgcagaccctacctgtccggagtaacggtcaggagagaggtggggaagggctgggcccctctcggtgtcccgggttcccggcagaagtctccagggctgaggcagtctgcagacacggagtttccgtgccagaggagagggtccacgcggacaggcagttccagctccgggacatactttattcagctgggtgctgaaaaagaatcttggaaattaggaaactgaatgaggcctcatttcacactcagaatgtgggttgcaatagtcacttcctctgctgctgggaaagaaagaattatactaccttttgaattttggattaaggagagaggtgttggcttgtcaaactaccatgtattcctcaagacatatttttgtggctttataaaattcaatatatatgtctaaattcaaaaatattttgttgcaatctggcccttggacaaactgaggccctagcaactgatgtttatggctttccgtagaacctttcagataaaatttacacagcattttactgcagctatttcacacaaagcagaggattttgccacaaaactgaaagaaaaaagaaactgcattcttaaatttttcataaatcaaaaggtataaaaatatctacctaaacgataaaggagatgagaaaccccacccatgatgggaagaaagcctatttcagttttgcctttacttcaagttcttttttccatatctggaatgcaatcagaattttaatcttgccttgggttcctcctggatttggggagaagacaaaacctgaaaatctctaatctgcatgtgttcagctgcgtatcttctggatacggaaggatcacactgcacagagtgctggacttgcaggagccccgcttctcaacctccatcgctttatgaatgaattcaccagaaagaaaaggaagaatcaacactttcagagatggagcctgttgagccacagtaccaactagtcaatgctgaatcgacttctccctttctacattgcctgagagaagtcattggggaatactctgtacacgaattttcactgttggggaaaacagagagtcaagggattggattgtggattgcattggtggttttcctcagtttcctcatcttctccacaagtttctacatatcgaatgcagagcagcccttcttcaaaggacctcctacggaagctgctaaggaactcagtctgtagctctgcgtggagccatgtgtaaacactgaactgagacctgccacctcctactacctaagggcccattttcatctgatatcatcccccagaaacaaactcatgatgacttccatgttttttttagattagatacatggagaattttcctttcccttagaattaaaatcctgcattctaaaaatcagtaagcttttttatttctgaataattttaaatttaaagagaagttgcaaagatagtatagaatgttcccttatacctgtttttatttagagtgatgttcccaggagaaatgataatgcagcaatggacaagaacaggaacaagagacagtcttaccatcttcttacaatttatagatgggacagtggaaagagaagccacatcggggttgggcatgcagagacctggtcctaaatctgtgtgacttttgcgaaatccttttgcctcacagagctctaggttcttatctgtcaaacaggaaccagaccatcagatccgtagagatccaaccaatgaaggagacttcgaaaacttcacattgccgtgtcaatgtgaggttgctggatggttatgacaagaaatcacattaaattcactggggtaacattgttcatgaaacgggataatgtgtttcagcgatgaaccacccatggccttactacagacatatttccactttgaaaatgtgtgtgagtgtacatgtctgtgtgtgaggcagagattagaaagtgtaaatgtgtgcgttttcattttacacatcttacattttcctttaatttgtttgaaagcctgttttgtttgtggcttccattcctggaagtcccatgagttgttagtggtgaagatggaacagatgtgtccaacccgggggactcctgccctcagggactgagcagctgcaaacctctctctcatctgattccactgtttcttccacatgtacacatcatgagaaatattgttcaatcaatatcttcccttaaatcaactcatatgcttatttacatgaatttacctaaaacagaaacttgatatcacttctgtaaatgaaaaaattaaactttctggctttaaataaagcataacaataataatcatgtcaaaa

SEQ ID NO: 57521 - DNA, 369 bp, Homo sapiens
ttttcttttttgtttaaaaggaatgaagtgcttcgtgctgcatcctgccttcaacgacaggaaactgagtttgttacacaaatctctggaagatatggagctaggaagagccgttgccgtctgcagctactgaacacagtgtgatagcacactttatctgccagagctcagttcccaactgtactaaggtttttaaaggcacattgaagttgcagccagcaaacttcagtaagcaacacagcaactcctaaaatcgccctatttggggagggggaggctaagacttattaacttcattatattatcgccaacagtgtttatgtctttcaatttatgtcttattaaatattcattatttttaaacccacc

SEQ ID NO: 57522 - DNA, 326 bp, Homo sapiens
  misc_feature (213)..(213): n is a, c, g, or t
tttcgtggttgcatagtattccatgatgtatacgtaccacgtgttctttatccaatccactgttgatgggcagctaggttgagtccatgtctttgctattgtgaatagtgctgcaatgaacatatgagtgcatgtgttgttaagttccatttcttgacgtaggtggtgcactgtgcctggcctggaaaactaaatattgtaaagatataaatncttccaaatttatctatgtagattcagtgtggtttcaaataaagttgcagtagacagtatttataacaaaagtaggtgacgtggtgtgtgagggatggagatggccacccagg

SEQ ID NO: 57523 - DNA, 329 bp, Homo sapiens
gggaatacccaagacccttttgccatccacaaacagtggtaccactgtgctagtagtcattatattcttcaccgtcatgcactaggtttcatttaagaatgtgcatgaagacaccataaaactaatgcttttattaaaacttgaaccatcttaataatattttgtatttgacaaaatgggaagtattaacatacatataaagcagttctgcataccaaagtgcagtgattgtctcaaggaatggtgccttctggattgaaccagagactgcagaatcatgcatgggtaaaagatccattcaaagtgcaaagtaggctgggcatggtggc

SEQ ID NO: 57524 - DNA, 861 bp, Homo sapiens
gtttgcagcccctttctccctgcttcctgccggcgcgagcagccccccgccgcggcctttccgcgacccgacggccgccccccattgatttgaagttcacattcttcgaggttcacgcccccttggcccagagatttttttttttccccagccaaaaaatagtgagatgaaataacgggatcgagggagaggaatgttgctaccatttatctttgttgttgttgccgttgttaatatttgggggttttaatcagttggaggtgtttggagaaagggagcgttgagatttggggagttagatttttccagttaaatgttgcgagtagtttttcttatttcctggaaattctggtcaccctttgaaaagggaggtttgggaagcgtcagtcattaggacgttgacagctaagttagattaattcagacgtaccttaaataggctttgttctcaccattcccttgtttcgagttgccttcagattattttggaagagttcttactacaagatgaggctttttatttcacaaataatgaatctacacacagaaaataagtggtttgggtttttggtgtttcgtgggggttttttgctagctttgtgatttgcttttgtcttaaatttaagaaggaaagaaagcaataattctttccataatttctaatagttatgttagcatctagagaaattttctctttacgtcatcttgacacttaactatttaagaagttcgatatttgtgactttttcagaccatatttatctactgttaagtgtctaaatctgtcgctaaaattggggagtaaaaataagtgcttggtatttttcagagtgctagagtcgatttgatgctgtaaaagta

SEQ ID NO: 57525 - DNA, 807 bp, Homo sapiens
gtttgcagcccctttctccctgcttcctgccggcgcgagcagccccccgccgcggcctttccgcgacccgacggccgccccccattgatttgaagttcacattcttcgaggttcacgcccccttggcccagagatttttttttttccccagccaaaaaatagtgagatgaaataacgggatcgagggagaggaatgttgctaccatttatctttgttgttgttgccgttgttaatatttgggggttttaatcagttggaggtgtttggagaaagggagcgttgagatttggggagttagatttttccagttaaatgttgcgagtagtttttcttatttcctggaaattctggtcaccctttgtaattcagacgtaccttaaataggctttgttctcaccattcccttgtttcgagttgccttcagattattttggaagagttcttactacaagatgaggctttttatttcacaaataatgaatctacacacagaaaataagtggtttgggtttttggtgtttcgtgggggttttttgctagctttgtgatttgcttttgtcttaaatttaagaaggaaagaaagcaataattctttccataatttctaatagttatgttagcatctagagaaattttctctttacgtcatcttgacacttaactatttaagaagttcgatatttgtgactttttcagaccatatttatctactgttaagtgtctaaatctgtcgctaaaattggggagtaaaaataagtgcttggtatttttcagagtgctagagtcgatttgatgctgtaaaagta

SEQ ID NO: 57526 - DNA, 138 bp, Homo sapiens
gggacctggaagacaagggggatcaggaagtgagtcttgcagcttgtcactaggaagccttgtttggggtccccatgcccttgaaccaggtgaacagggcggggagctaaggcgagctctggcctcttccgtccccag

SEQ ID NO: 57527 - DNA, 331 bp, Homo sapiens
ttggctctgagggcacccccatgagacgctgacctacagtgctggggcattcactcagctccccaaactttgcttccgggtgtctggcgcactccagcagcaccagcagtttccacccggccctgactctgcagctaaagacccacatgcctagaccagggcgtctccctagaagggcttctcctggagatctctagggactgactccttggcaggctgggccgggctctggcttccatccttatcattggaaatcatcaccgggcactggaactagagggtaagaggggagggagaagtgcagaggctggacaggcaaaggacagagcag

SEQ ID NO: 57528 - DNA, 702 bp, Homo sapiens
caactcccctcattgtgtgtccttgagcaagtgacctttgtctgagcctcagtgtcctttcctgggactgttatgaggacccagtgtgatcatgggtgacacttgacagacatgtcagagttggtggcaggtggtggttcgcaattttggcagggacgtttcagggaaggtgttcccgataaaggtgacatttaagatatgacctgagggagggagccgtgtggctatttgaaggaagagagatccaggtggggagagaataacaggcataaaagccttcgagcaggagagtgtgcagaattccaggagccacaaggagctcagtgtggctgaagcagggtgaacgggtgacaggtcagaccttgagggccttgaggaccaacaggaagactttggcttttgccagtcattgttgctcatgtgtctactcctagctctttgggaggctgaagcgggaggatcacttgagcccaggagttgtcccagctaattgggaggcccagatgggaggtttgtttgagctggggagttcgaggttgcagtgagtaatgattgtcccactgtatccagcctgggtgacagagtgagaccctgtctcaataaaataaaataaaagaagttctgcagtaggactgttcatgttaggaagaaaacatctttttcatatttttattaaaataaaataaaagaagttaaaacgtt

SEQ ID NO: 57529 - DNA, 411 bp, Homo sapiens
tgaaaccctgtctgaaaagaataataataaaataggccaggcatcgtggattatacctgtaattctagcaccacgggaggctgaggtgggtggatctactgagctcaggagtttgagaccagcttgggcaacatggtgaaacccagtctctacaaaaaattagctgggggtggtggtacacgtctgtaatcccagctacttgggggctgaggaaggaggattgcttgagcccaggtggcagaggttgcagtgagccgagatcatgccactgcactccagcctgggtgacagagtgagaccctgtctcaataaaataaaataaaagaagttctgcagtaggactgttcatgttaggaagaaaacatctttttcatatttttattaaaataaaataaaagaagttaaaacgtt

SEQ ID NO: 57530 - DNA, 174 bp, Homo sapiens
aaatgtaaatcaaacgcaatgtggtaggcgaaatcggtgccctcacagcatccggcaaaaggtgaaagcgacccaggagtacctgagctccaggtaaccgccctgcccgctgggcttgggacaagccggcgggcgaggtgcctcccaggccaacaagagaccctggcccagggg

SEQ ID NO: 57531 - DNA, 257 bp, Homo sapiens
gacggtggctagggggaaaaggcctgaacagaggaggtagccaacccaggtacgctaggaggcgggggccccagagtactcccctctgcagcgatggtcaggaggcccacgaggtggctgcggggcaggggggctttttctctgccctggcgtggccattagcgggtgggagaagcaggctgagctggggcaccaggcatgaagactcggttgtctggctcagctgctgatggaggagtgccccagaagcagaagtg

SEQ ID NO: 57532 - DNA, 991 bp, Homo sapiens
aactgtagaagcattctgttgacaatgaaatgcaagagaagaatggattttaaaaatcttactctatttgtaaaaattcatttcaacgaagatctcagtgtttacaaaaaaaacctctaccaactatacatgatctttattttatcttaattttattcttctaaacatcttcatcttagtatgctgcccatttggagaaatacatatatttcactgtcattcctagactttctttatttgcagtgattaaattatggcctatatagtcttgccttgcaggtcccttgccctaagaaatacactcacatgacatgactagatggtgtcaccagctactgaaagtacatttttgaaattgtcatattgtatgagcattttttcaatttaaagtaaatcaaatcttctgtgtaggttcatagaaactaaacaaccaaaccttgaaaaattagttaaaaacagcttaaagtagaaatgattaaaatgctagttgatgtattcagttatgattttttttggctactcatcttctacacttcgatattattatatagatgtctagaatgtttcatatgtatgtttttaccttgctgtacaaaataaggtattatatgtattcatctacttgtgtgtatagaggttgtattatataaatgccaggcatacattttaaaaagccattttgtataatattttgattatgaatgattcattttcaaaataacatatgctgtggttgaaaaaaatagttatgttgggccactgtttattccactgggtgaatgggagatacttctttgttcataagtaaatatttggttcaagcctgggccaggacaagttagttcaaagaggaagggtcaaatgggaatgttattgatcactgcaaatagaagaacttcatacagaataattacccatctagatagcaacaaaaggaccatctcctgaaatgataatcttggcactatcttagagtccaactaaaaaaaaa

SEQ ID NO: 57533 - DNA, 370 bp, Homo sapiens
ttgtatttttagtagagacagggtttcaccatgttgcccaggctggtgtcgaactcctgacctcaggtcatccacccacctcggcctcccacagtgctgggattacgggtgtcagctactgtgcccagcccagaataagggaactttatgttcaaacacgaataatatcaaaaatataattctgagcaaagacagctgcagaaagatatttgcagtatggtgccacttaaaacttttaaatgtgcaaaataatattgtttggggacacttaaatgtgtaacgagtataaagccagtatgagagtgattaaactctaagttcaggactggagaacttcagggggagcgggagaggagggaaggagggaaat

SEQ ID NO: 57534 - DNA, 951 bp, Homo sapiens
cggtagtggtccgtgaagtccgcggagtgggcgctgatggtggggctatcccttcccactgtccgcgaggtgcgccgtggtaacgcgcggggacacagcgcgggtgtggaccccctgcccacagctggcgcacagccattgagtgtagacccgactggggcacgaccactgaaccctgcacttggcgtcctccgggccccgcgaggggccttgctgggcgggtccgcggcaccccgggttcccagaagtcgaggccccgaatgcgcctcccctcgcctggaatcggagagcggagggctcctgcgggcaggtggccgtgctccgaagagcgccctgccacccatgaggtggccctgggggcgtcgctagccttcccagctgggtgtcctcatccggagacacaaacacctgcctcaggattaaagcgaggagctgtatttcagaccgtctcaggagaaatagcaagaggctgcctcactcctttgcccttgttcaagtttgaggcattaagaaggataagacatcaatttgaaaagagcccctgtcagagcaacatgacttgaaagcaagaagaaaaaacaaaaaatgaagcaagaacaaacatcaaatttatgctgagtttggctgcaagaatggtgaaatcattgatactttacaagacactaatcaggacagtgccccaaaggaatcagcagtttacaaatggatataacctgttttcagaagagacaagattaatttgaagatgaagcagtggcggaccatccatgtcaatttatgagaaaaaaattcattctgttcatgccctaactgaagaggactgacaacagcacaaacaatagccaacatcatagacatctcaactggttcagcttactcaattctgactgaaagttaaagttgagcaaactttccactcaatgagtgtcgaaaccctcatgcccagatcag

SEQ ID NO: 57535 - DNA, 1074 bp, Homo sapiens
  misc_feature (16)..(16): n is a, c, g, or t
agcgggtcactcagtncagctcccatgcaaagttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtggggaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgttgctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtcca

SEQ ID NO: 57536 - DNA, 821 bp, Homo sapiens
  misc_feature (16)..(16): n is a, c, g, or t
agcgggtcactcagtncagctcccatgcaaagttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccagatgctggtcaacctctggggcccaaagaagaccatcagcttcctgggatgctctgtccagctcttcatcttcctgtccctggggaccactgagtgcatcctcctgacagtgatggcctttgaccgatacgttgctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtcca

SEQ ID NO: 57537 - DNA, 1151 bp, Homo sapiens
ataaccatgcttttttcatctccaaggtggtaatgtgatggatttaggtgatattcaaggagattcagtcaataatgagacataatgaacatacagaatcattacaatatatattgcctataaaagtggttttatgacagagatcctaagaaaaatattttagtaacagaaatatatactttggaagacaataatgagattactttgagaaacattatatgggtgactatattagcatgcttctaataatatgctttgtgagtattgtttacttttgtatatcatattttatatcagtgaatactagataaagggtaatcagcaaatgttttttgaatggataatctctaactgaaagttaatttctactttttccactaaatattgattagttaactgtacagtcccgagtcacctaacatcagggattcattctgagaactgcattgtcaggcaagttctttgttttgcaaacaccatagagtgcacttccacaaaccccgacaggatagcctactacacacctaggctatattgtacagtctgttgctcctagtctacaaagctgcacagtgtgttactatactgtaggcagttgtaacacaatgataagtatttatgtacctaatcatatctaaacctagaaaaagtacagtaaaaatatggttttgtaatcttatggccagacattcctatactgcctggtgttggctgaaatgtcattagatggcgcatgactgtattattcttatagtatgtagatttcagttattctagagttattttagaaaatgactgtgtgacaatattgaatactaagaaaactgtcaaattggggaatgacttcaaaatatttaaagtgcgtttgagttgtctttaaatttagattcatcacacttacatacttacgagtgagagtacctcatattttaagggaaatgcttgagaaatttacatgatttttgaaaagaatgagaacacagtaagaattctcttgcctgctgctttcttggaaatttctatttgaacagtctgttcagagcgatggggcaaagatgaggatgaggctgattaatcaaaatagtcttccgtcttccaactttatttgaaacagtttaagacagagtgagactccgtctcaaaaaaaaaaa

SEQ ID NO: 57538 - DNA, 374 bp, Homo sapiens
ggtcttgatctcctgacctcgtgatccacccgcctgggcctcccaaagtgctgggattacaggcgtgagccaccgtgcctggccgagataattattttttagtgacgatttagcaacctgaaaaccttgggtctttgggatatgacctcagtatcaacacagaatatttgaatgctggttaatatatttgttttaaactgtgatagaattgaaatcttgtagccacattttgaaagtttattcttcattaactagtcttttctcacctgattttctacaagagagaattttccaaaaggttagttgtcgttacattaagaacttgggttttgtttgacatgaaatgtttctacaccagcaggtctcagatgaat

SEQ ID NO: 57539 - DNA, 274 bp, Homo sapiens
ttttccgtagacagggtttcgccttgctggccaggctggtcttgaactcctgacctcaagtgatctgcctgcgtcagcctcccaaagggctgggattacaggcatgagccactgcacctggtcccttgaactctttttaatctatactcatttccgtgatctcatccagtctcctgactttcagtaccatctaagatatataatatcatcatatatgatgacaactcttaaatttatatctccagctcggatctcttacctgaactccagattc

SEQ ID NO: 57540 - DNA, 3079 bp, Homo sapiens
ccgggcaggcttggcggcccgcgtgggctcctccccgcggcgctggctcagtgcgaacccggcgagggcggctgggcgctttagaactgccctgcaggccaggaacctctgtaggtttccctggggaggtctggggtgggagttccgtacgccctgagctccaggttcttgtacttttcttagttgtgagggagggaatttgcgaaagaattttccttatcaggagattcaaacttgtcctcgcaaggaaatggataactcacatccacagcatgtcccttccttttcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggtatcatgatatctcttctagtgcagttttgtgtttactagtaaaatgatcaaaatatccattcaatcagaaattacagaattttaatctgggtcttcattaatatgtatagcacagaatttctgaatcaaatttatgtaaagtcctacatacattttatatcaaagatgtttcatatcaagaatgtcctcttaggtttagaatcttttctaagatgggcattttttactagctgtagtctgtgacaataaagcgtcaaaagagaatagccttgaggccaggtgcagtggtcacacctgtaatcccagcactttgggaggctgaggtgggtggattgcttgagcctaggagttttaagactaacctgggcaacatggcaaaaccctgtctctaccaaaaatacaaaaaattagttgggcatggcattgtgcgcctgtagtctcagctactcgggagactaatgtgggaaacacctaagccccggaagttgagactgcagtgaaccatgatcgtgccactgcactctagcctgagagttggactgtgaccttgtctcaaaaaaacaacaaaagaagagggaatagcttccaagttcttgtcaggatagatgagatgatctagtctgaaatgagatttcaagaagtggctatacctttagattagggatgggaaaattttgcgaaggtatgctgaataggaagatatcccagattaaggttataggttctcaaccggcatgtcttgagtgcccattatgtgcaaagtcctcttagtttctggtaatacaaaaatgaaggtcagaacccttgtcctcaatgatctttaattagacattgggagaaattaaccaataatagtatgatttaagaactaacaggaatgaatacatcaggtgccactggagaaaagaggaattcctcattcagcttgtggttagtggaggctcccaagaggagtagacatctgtactgaagcttaaggaccaggaagtcagctgacaaggaagagggaagatcagcttaggcaaactcccaggaagagggaatatcagcttaggcaaactcccaggaagaggagagggcatggggtattttgaatattttatgtaacactttattgcagctagaatgttcagggtatatgacatcatgaagtggctgtaaaagttgaggctagaagtgtggtgggctcagatcggaaaggcccttttattccatctaaaggagtttgaagtttatcctgaagataatggtttttaatcagtggtacagcaaaagcaaatttaagttttagaaatagaactatgataaaagtgggttggatttcactggaggctaggtgaccagcaaagaagttattacagtaatctagtgtgagtaatgaaggaattctggcaataagaatgagaagggtaatagcaataacattcaataaacgtggcatcagtaaattgttcggtatatattggaacattttaataaacttggaacacttaactgcattatgtccattgtccctgaagcttgagagaaggcagagagaaaacttattttatataaaaaattttgagtgctgtgtcttagaataatgttcagttcttaatgaataagggtgaattttctagtaagagaatgctaggtgctgtgtagtgaataataggttaattctacagaataaaaaatgaacccttatgattttttaaaaagtaataaactgttaactttcccactgaattttaaagtaatatctctttgcgatagacacccagaaaacatgagaaatttacaacaaaaatataaattacctgtagtgtcagtccaaagaaaaacgatctaataacaaataattttcttctttatatgataggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcctgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaa

SEQ ID NO: 57541 - DNA, 920 bp, Homo sapiens
  misc_feature (831)..(831): n is a, c, g, or t
  misc_feature (837)..(837): n is a, c, g, or t
  misc_feature (841)..(841): n is a, c, g, or t
  misc_feature (843)..(845): n is a, c, g, or t
  misc_feature (851)..(851): n is a, c, g, or t
  misc_feature (853)..(853): n is a, c, g, or t
tcccagaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaattcatggacccttggggtttgggcnagaaantccntnnntttttncnatggggttcctagaatatctcctgaggcaggtgccgtcggtgaaatggcgagcgcatcgagagcacg

SEQ ID NO: 57542 - DNA, 1337 bp, Homo sapiens
tcccagaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcaggtcagcaccttttggggaaaccccctaatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatggtgagtgaagactttttcttgttcagttattgtaactgacatttataaagagaactttctaggtcaacttaaaaaacatacacacactaaagaaatgactaacaaatttgagttagtttcctaggattatatccatttctgttaactttacattcacagagaaatgaaaccattttattaatccaaaaggttgatttttatcctcattctttcctgtaataacattacacaactatatatgaaaagtaatgactcagttgtaacccccttgcttttaaaaattcaggtgagttgagtcgattgatgaaaatgcacttttcatggttattatagcatcaatttaaatagccaacggtataaagaattggcaatgaataataccatgttaagtatcaaaatatatatcatgatgaattgagtgcaagtactgagagcactatgggttacaccttgctgacaaggggatgggaagacagac

SEQ ID NO: 57543 - DNA, 1221 bp, Homo sapiens
tcccagaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcctgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaa

SEQ ID NO: 57544 - DNA, 1103 bp, Homo sapiens
tcccagaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcctgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaa

SEQ ID NO: 57545 - DNA, 1432 bp, Homo sapiens
  misc_feature (1432)..(1432): n is a, c, g, or t
tcccagaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcctgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaaaaaaaaaaaaaacacaaacaaacacaaccttttggggcgggctgggcccgagaaagagttttaaccattcggttgggcgccgggctgggggttagcgacctgccccggcgtccaggagaaccggcccgcaagggtgggttcaccaaaaaaccccggggccccgccttgaacacccaagggtggggcccggctcacgggcccggcccgtatn

SEQ ID NO: 57546 - DNA, 1305 bp, Homo sapiens
tcccagaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatggtgagtgaagactttttcttgttcagttattgtaactgacatttataaagagaactttctaggtcaacttaaaaaacatacacacactaaagaaatgactaacaaatttgagttagtttcctaggattatatccatttctgttaactttacattcacagagaaatgaaaccattttattaatccaaaaggttgatttttatcctcattctttcctgtaataacattacacaactatatatgaaaagtaatgactcagttgtaacccccttgcttttaaaaattcaggtgagttgagtcgattgatgaaaatgcacttttcatggttattatagcatcaatttaaatagccaacggtataaagaattggcaatgaataataccatgttaagtatcaaaatatatatcatgatgaattgagtgcaagtactgagagcactatgggttacaccttgctgacaaggggatgggaagacagac

SEQ ID NO: 57547 - DNA, 480 bp, Homo sapiens
tgttcctggcatgtttccaggtgctggacatacacagtcaacaaaacaaggtgtctgccttcatgaagctcacattctaatggggaagatagacaataaacaaatatgtaatatgtcaggagaagaccagctataaaaaaaaaaacagtaagataaagtggagtcttacccagtacctggcagacagtgggcactcaaatatttctaagtgaatgaagatagtatctgtatgctaaagctaataccttttttctctttccaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattata

SEQ ID NO: 57548 - DNA, 406 bp, Homo sapiens
agtcactcagaaacttactttgcttacagcctcattattgttttttgtatttgttaagatattccgtgtgatgacatattttgccttaaattttctaatttttctggccattgctttcctgtgatttgaaaatgttacggtaagtgcttagtttggaaactatactgtcaacatatattgcattacttcagcagagctgtagttccataacataataaaatgatgctttttttaataagaagatcatacacatttcattatgccctaaaagatgaacattcaaagttcacttttctcttgttttgatatgacggatatatatcagtaaaataaaaaatgctgcagaacaatatgcactaactcaaacatgctgtgatttgtagtgcactgagtagcaatgtcaaag

SEQ ID NO: 57549 - DNA, 448 bp, Homo sapiens
agaaatgaaggttaggaaagtagacagaaccttgtccgtcactgtgatacttgtttgaaaaataccagacacacagcacagtctactttcacagcagctagggctaatctacagctgtatatgtgtgtgcacacacatatgcacacttccatagaaacgtggttgacaccctggatgttacttctgtagttgaaaacagaccccttccctccatcccttgatccctacttctgctccagttatagcctctttctagaaatctttctgggtttctggcctatcctcctcctggtgggcagtactgttccttttgcacacaaagcagagccatcgtggaaaggcagttctggagagccccatgaacaggtgtgcaaaccaggaccagacagatctggaaaaagcagacagctagaggttggtgcaaggggtacaggcaggtaagcaggga

SEQ ID NO: 57550 - DNA, 1165 bp, Homo sapiens
tttttttttttaattcatggtcttgctctgttgcccatgccgtagtgcaggggcatgatcagggctcactatagcctcaacctcccgggctcaagccatcctcctgcctcagccccctgagtagctgggactggcatgagccaccacactcagacatataaaggatcttacataaaagtcagtttcgctttggattattgcttagatgatgtatctctacagatgtactgagattctgctgtagttttaagattttactgggacagtttgggcagtttatcagaatgtagaaagtatgtcacaatctgtctgccttaaccaaaatagtgggtatgtaataggtatgccacgttgaccttgattcctggaagttggctaaaactaggattgagcaagcatgcccagatataagatcaacctctgttgatggaaacctacatttgactaaagatcctcatcagcagtatggaatagttattttagttatttgtcactcaaaattttgctgtcttttttaagaaaatatttattattagtagagaaggaagtcttctgataaaactagcatatcttttaggagatttaaggcattatgctcatatcactttgagttctgtgttttatggtgggtagaccacagtctgacggacttatgaaacattctgaatcgtgagggctccctgagacccagttaagtattcgcccagtgaggtttttggccttctcctgtgcctttgcctgccttagctctctctcattggttggtgagtcaagttgatccttgcaagagctgctgtttattgtgtgctcatgattcagccaggcactaagtacttctcatgaattacttctgttccttacacgaaagcatgtaggaaatgagaggctgatatgggagctgaatctggggctgtcttactctgaggtctgggtcactccatataccatgctacctctctggttcactctagtaaatctagcttctaaccaaggtgttttcagttgttgatgagaaaagcctctctgtgtattgactccagaaaagcattgatgctcgtccaaaggtagtgagttagctcagttgattgttcacagtcagttacggatcgaacagtctcgttctagtctttcctcccttactattgcacttgactagtctttaaaa

SEQ ID NO: 57551 - DNA, 254 bp, Homo sapiens
ggtgggcgctattattagccacgttttaccgaaggggaaactgaggcttagagcggtgaaatgctttgttggaggtcacacagatggtaattggttgagcctgaactgaaactcaggctatctgatgccagaacccaaactgtttccccaactttcgacgaccctgctttatcatctctcttgggggtaggcaagcttctgtgaagtcataaaacccatgtttttggctctgtgggccacaagagctccactgc

SEQ ID NO: 57552 - DNA, 1461 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaattcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaag

SEQ ID NO: 57553 - DNA, 4569 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgtt

SEQ ID NO: 57554 - DNA, 4590 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttttgcaaaaaaaaatacttgta

SEQ ID NO: 57555 - DNA, 5048 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgtggttccaagaagaaacatacgaataatcaagaataacagaaacagatcgtgtgtgcggcgcgcgccccttgggccccttcgagaaaagagccttttctatagaaccccatttcgcgtgtgtggggcgcgcgcgcgcggggcccccagttggtgctctagagtgtgaacccgtgtgggccccatatagcgctgtgtgtttctcctatgagagagagaaactcgcgtggggctccaagaggaaccaaataaggcgcgcggtgggggaattctcttctccacgcgaattataaaaaaaaaaagcgccccgcgggggggggggaaaacccccgaaagcgcggttctcgtgaacaacaaaatctcgcgagaagttggggacttctcgaggaggggctcataatcaagggggaagctcatatctaaacggggggggagtctccccagagggaaagcctccgaattattcaaaatttagcgccc

SEQ ID NO: 57556 - DNA, 4439 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattacttctttcctttggcattttcaatttgaaatgctttccttgtggccgaaccccggggaactcctctaga

SEQ ID NO: 57557 - DNA, 2965 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccggggggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgtt

SEQ ID NO: 57558 - DNA, 3238 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaattcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgtt

SEQ ID NO: 57559 - DNA, 2792 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaag

SEQ ID NO: 57560 - DNA, 1872 bp, Homo sapiens
acatgtataactgtcactgttaaacattgtgaaacaagaaatggatgtgcacaactcgacacttttctagcattcttgaactaattcacaaatgcaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgtt

SEQ ID NO: 57561 - DNA, 2139 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttcgcaatccaggtcaagaaatagaacatgaccagcactccagaaacccctattctctctcccagttactattttctctcgccagctccc

SEQ ID NO: 57562 - DNA, 1990 bp, Homo sapiens
actgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactattctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgtt

SEQ ID NO: 57563 - DNA, 760 bp, Homo sapiens
ggttactaagaggtgtactctgtgaagtaaacgtaacctattagcattaaaactacagcattgagcctggcccaatatctcattaactcttcatccaaaaccaggactcagctggcagactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgtt

SEQ ID NO: 57564 - DNA, 636 bp, Homo sapiens
tgctggccggccccaagttatagaagaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgtt

SEQ ID NO: 57565 - DNA, 461 bp, Homo sapiens
gaacttcattatcatgctgtttgaagatttaaactgtcctgtttgggaaattaggtgtcctctctctcctgatttcttagaagataacatagcttagtttaggtttagcgatgtagaccttaaggtgaatgactccatttttatttttagtctgccctgttggggcctagtataggagtttagtggcctcctataatttttatttcacaaaacaaaagtatacatcatatcagtgaatatttgctaagaacaggaaagagaagtcttcctttcaaatagcttattgttcattggaatgaattaatctaggcacagtggctcatgcctgtgatcccaacactttgggagaagaggtgggaggattacttgaggcttggagtttgagactactctgggcaacatagcaagacctccatttctacaaaaaataaaaataaaaaaatgaattaaatacataaagc

SEQ ID NO: 57566 - DNA, 957 bp, Homo sapiens
ggttgcttccaaattttggctgttgtgaatagtgctgcaacaaacatgggagtgcaaatatattttctatatactgatttcctttcttttgagtatatgcccagtagattgttgggtcatatggtaactctatttttacttttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattataagtaaaactgcctttgctatatagtatgcatagaatattttaaagttattactagaagctgacacattgttgttttctattacaaacaataaaattagtttccatttattgagggcctgtttcatgttaactgctttacaaatattccttatctcatttaattctcccaacaatcctacaagaaagctaatattatcccattttatagatgaggaaattgaggcttacagagggcaagtaacttgcccaaagtcactcagtaccagcaaacggacttttccccctctccctgcccccaaataccagccccccactgcaaaaaaacaaaaacaaaaacaaaacaaaactacttctgtagagctagttgtctatttccaaatgcaaggcttaaattttaagccttggagttttcaatttaaagcctttgccatgaaatacagcatattactttataatagaaaacaaatagaaagagcctttcatgatagatacagtgaacactaaattctttcttttaggctgcatctaacaattctctccttaacccaatagatactatttcaacaaattagcccagttttgatttggatggcaagactcaaagacaacaacaacaataaaatcacaacttgatttaaaag

SEQ ID NO: 57567 - DNA, 832 bp, Homo sapiens
ctatctccacccatattactttttcttttgttattttcatattttgttttcagttcaagtgccttgactttttgtaatataagaatttgaaattcttgcaagaaaatttctttggaacttttgtttgagtaaaatgattttaatgaaatgaaagctatgatttacattactagatcaccagtgtgaatagaattacaaataaatagcctcttttatttttatgtggtttatttagagtaggaaagtagctattgtagctccctggtctgttgcactttttgcagttccccttctgtgatgcgcttttatacaattagctataaggtttttgctttttttccccccaaattttgcttttttcccccaaaattagtgttgtgtttaaatagatacagtatttggatgtagtatttagatatagtacttagttactaaggattatgtttaaaatccttgatattgtgtgtatttgaagtttaagagaggaatttaatactttacaacaaacatactttatagcccctgacataatgtaatcatactacaagactaaatacttgttccacgattgctgatcttgtacgtaacgttttttgttctgattttggaattgtcctcaagacaatctcattcaacatttattcctttatttattaatttgtttttaaacaactaaaaaatacagtaaaattttacaaattgagtttcatttattggtatagttttgttattttatagtatcactttttatatggcaaagaagctatgatttgcttttaataggcttattgtaagtatgccattaactttttcattttgaaaactgtatttc

SEQ ID NO: 57568 - DNA, 776 bp, Homo sapiens
  misc_feature (613)..(613): n is a, c, g, or t
ctatctccacccatattactttttcttttgttattttcatattttgttttcagttcaagtgccttgactttttgtaatataagaatttgaaattcttgcaagaaaatttctttggaacttttgtttgagtaaaatgattttaatgaaatgaaagctatgatttacattactagatcaccagtgtgaatagaattacaaataaatagcctcttttatttttatgtggtttatttagagtaggaaagtagctattgtagctccctggtctgttgcactttttgcagttccccttctgtgatgcgcttttatacaattagctataaggtttttgctttttttccccccaaattttgcttttttcccccaaaattagtgttgtgtttaaatagatacagtatttggatgtagtatttagatatagtacttagttactaaggattatgtttaaaatccttgatattgtgtgtatttgaagtttaagagaggaatttaatactttacagcatttctcttgtattgatttctatttttattccattgtggtctgagaagatagctgacatgattttttcagttattttaaaatttggttgagacttgttttatgtcctanaatatggtcaattctggagaatgtttcatgtgctgctataaaaatgtgtattctgctgctcttaggtgaaatgttctgtaaatagctgttggttttatttggtctatgatgcagttgaaaactatgtttctttgttatattctgtctagatgatcatgcagcg

SEQ ID NO: 57569 - DNA, 607 bp, Homo sapiens
cacctcaaaaaaagaaaaaagaaaaaaaagaaaaagaaaagaaaaagaaatggaatctcccttacagtgtgacatgcagctgggttgtccttggttgctcacctgacacctcatcccaaggtatagctgtgttcagtgtactgtacaccagttccttgatcacctcttgccaacgtagggcaggaaataggagagaatctctttctattttggggaaacaaaactagtatctaacctaacttgagaaggtccccttgcaagaagaggtttttcaagtactctcagaccagcaataattgcttgtgagatctctcaccaaaagagtactataaaagtcacttaacacacagcagtctatacactaactattaggtctggaaccaagctctggaaaacaaactatcttttaaaataaatatgtttttctttcaacagcagcctcaccccaggtggaggggtactgacagcatgtgactgtggaggtccacactctcttcattcaaccatagcgctcttactcatcagagggcactgtcactttcgtcaatacagatgcctgaagatggctaacagaggccctagccatttcaccgctgtgtcaaattgg

SEQ ID NO: 57570 - DNA, 434 bp, Homo sapiens
cggcacgaggtaccaaaccaaattcaaaggcatattaaaatcatacacgatgactgagggagccttattcctaggatgcaaggatggctcaacacacaaaaatcagtaaatgtaatacaccacattaaccgaatgaaggacaaaaatcatgtaacaatctgaactggtgcagaaaaagcatctgacaaaattcaacacctttcatgataaaaacactcaacaaactaggaaggaatagaaggaaattacctgaacataataaagaccatacataaaaagtccacagcaaacattacaatggtgaaaaactgaaagctttccctctaagatcaggaacaagactaggaagtccactctcaccacttctactcaacacagtacaatcagaaaaaggaggcaagaaaaaaaggcatccaaattggaaaggaagaagt

SEQ ID NO: 57571 - DNA, 365 bp, Homo sapiens
cctcttggaggtttctatgctgtttatcttttttcaagcaaagggaagtaaaaagcaataggagaactttctttaggccactgtttccatgagatcgcattcctccacacgagggctcttcaaaaaattgaagatggtctattttacaattaaaaattaacttattaggttaagtgtttataattcctttaagaatttccttggagtaagcagattgagaaacttccccacttttcaactcaggtgttttccactcataattttctttcaaaatggattccgtgaattttcttaggccaaattgtcacctcctttttaatgataccaggcagaaagaattgtagccctgtttcaagaaatgtact

SEQ ID NO: 57572 - DNA, 298 bp, Homo sapiens
aaaatatcgagtgaaacaaaatagcttatatatttggggagtgcacagacatgatgtaaaagggataaaggggattataaatacagtttagtgtttcaaagtgaaaaaatgatgcatatttcttaagataacagcattaaaagctatacatgattgaccagattgtcatcttagagagcactttttcttggaaataggccttttataactctcttcttgacagattttgaagtgttatacttgtgttttaggggaaatttgatttatcaaattggtggatagagagaaagaaatactg

SEQ ID NO: 57573 - DNA, 489 bp, Homo sapiens
ttgggatgcatcatgctgactatggttttctactttgacctgttaatatggtgaattaaatataatgacatatcatcgatcatccttcaatccaatcttatttggtgttacactttagttttgttattttctttaggattattgtgtcaatattcaaaagtcaaattcatgtgtgttatatgtttgcatgtaatatatttcaatattgtgctttcttcatacatacattttggtagattttcttctttctcttgtggaaaatctgattggctaaagttttctgggcatgggctgtgtgtgtgtgtgtgtgtgtgtgttttagagggggcaaagggtttttgtttctttctgttggagagagatttatttatttagagatggagtctcgctctgttgcccaggctggagcccgggaggtggaggttgcggtgggccgggatcgcgccactgcactccagcctggccacagagcgagagtccatctaaaaa

SEQ ID NO: 57574 - DNA, 1191 bp, Homo sapiens
ttgggatgcatcatgctgactatggttttctactttgacctgttaatatggtgaattaaatataatgacatatcatcgatcatccttcaatccaatcttatttggtgttacactttagttttgttattttctttaggattattgtgtcaatattcaaaagtcaaattcatgtgtgttatatgtttgcatgtaatatatttcaatattgtgctttcttcatacatacattttggtagattttcttctttctcttgtggaaaatctgattggctaaagttttctgggcatgggctgtgtgtgtgtgtgtgtgtgtgtgttttagagggggcaaagggtttttgtttctttctgttggagagagatttatttatttagagatggagtctcgctctgttgcccaggctggagtccagtggtgcaatcttggctcactgcaacctccacctcccaagttcaagcaattctcctgcctcagcctcccgagtagctgggattacaggcatatacaagcacgctcagctaatttttgtatttttagtagagatggggtttcaccatgttggccaggctggctcaaactcctgacttcaagtgatctgccttcctcggcctcccaaagtgctgggatgacaggcgtgagtcactgtacccggctgggaaatgaatttttaaaaaaaaaactttatgtatttctacttcttcattggaaagtcattcgtatttacttaagttttcaaatatcacagtgcagattagaacaaagtagttgtttataattcttccgcatcctccaagtgtatggagaagctcgcattcttcttgttttgtgctgtcattattttagtttgttatcttcgtctactttagttttctcagataatgtttaaattatttggcaaatcatttctcaattttcaatgcattaatttcctccacctgcttttctggagtttcatgtgatacccactctccccacacaggatgacttctcgagttgaatgttcattccatttattttcattctttcttgcttaatgttgtaaacaggcgaggttctaacttttcatctgtgtactacaagctctcaagttctttcatggggagtttgtatcatggtcattttctagtatttagcattttcagcttttgtttcctgtcaactcaacattaaaagttttttaaaacgtcagg

SEQ ID NO: 57575 - DNA, 289 bp, Homo sapiens
gacaaattcaacccaccacataggccctcccgaggccacctctgcgtcatctttgtatacagattctgtgtccgtcttcctctcctcattgactctgcatgaaggggatttctggtggagtaagggtagcagctcttgccgcacgtgcagagagagaggaacttccagtgcccgctatggagccacagcccacagcatggggaagtccccatccagaggcagtgctgcagctagaggtagctccagagtcctccgggccctgcaccgatacagccaaagaccagcaaag

SEQ ID NO: 57576 - DNA, 3446 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggtgagctgcgggcggggacccggcctaggcgggggccgtctccagggcaacgcgcggcgcgggacccggaagtggctccggcaggggctctgcagccagggggcccggcgcggcgcggcgcaggcccggtgctcacgcggagttggccggggcccgttgcgtctctgcggccccgaggaaacagtcctgggtccatgggccgggccgagcgggcgtctgcagaaacgcagggacccggatggagccgcgggccgcgagaccctgcggggacacagctccgccgagtcgcgtttgagtggcaccgccatggctggggtcccggccggggcgagctccaggccaaggccggccttaaatagggccgctctggcccctgcaccccgtggaggagccgggcggagggagagggcgaggtcgggcccctgcgggcacgggagggtcaggcggccccggcccctccctcctccgccctggccaggtccccacggcagggccccaggctgaatctgaaggcaggcgaagctcttggcaacagtcccctgtaatgttaccaactttcctgctcagattttatttcctgacctttgagttcattccgtctacagattatttcggcaaggtataacgccgacgcctccccccagggtcagctgcgggctcccaggcctaggcgcccatgacccctacgccaaccgccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57577 - DNA, 2416 bp, Homo sapiens
cgacggccaccgtagggcggcctcacgccccctccacccgcgccgaccgagccgcacttcccttccccctgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57578 - DNA, 2640 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcggggcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57579 - DNA, 2312 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcgggctcccaggcctaggcgcccatgacccctacgccaaccgccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57580 - DNA, 1348 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggtgagctgcgggcggggacccggcctaggcgggggccgtctccagggcaacgcgcggcgcgggacccggaagtggctccggcaggggctctgcagccagggggcccggcgcggcgcggcgcaggcccggtgctcacgcggagttggccggggcccgttgcgtctctgcggccccgaggaaacagtcctgggtccatgggccgggccgagcgggcgtctgcagaaacgcagggacccggatggagccgcgggccgcgagaccctgcggggacacagctccgccgagtcgcgtttgagtggcaccgccatggctggggtcccggccggggcgagctccaggccaaggccggccttaaatagggccgctctggcccctgcaccccgtggaggagccgggcggagggagagggcgaggtcgggcccctgcgggcacgggagggtcaggcggccccggcccctccctcctccgccctggccaggtccccacggcagggccccaggctgaatctgaaggcaggcgaagctcttggcaacagtcccctgtaatgttaccaactttcctgctcagattttatttcctgacctttgagttcattccgtctacagattatttcggcaaggtataaccccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57581 - DNA, 2820 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcgggctcccaggcctaggcgcccatgacccctacgccaaccgccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57582 - DNA, 3233 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggtgagctgcgggcggggacccggcctaggcgggggccgtctccagggcaacgcgcggcgcgggacccggaagtggctccggcaggggctctgcagccagggggcccggcgcggcgcggcgcaggcccggtgctcacgcggagttggccggggcccgttgcgtctctgcggccccgaggaaacagtcctgggtccatgggccgggccgagcgggcgtctgcagaaacgcagggacccggatggagccgcgggccgcgagaccctgcggggacacagctccgccgagtcgcgtttgagtggcaccgccatggctggggtcccggccggggcgagctccaggccaaggccggccttaaatagggccgctctggcccctgcaccccgtggaggagccgggcggagggagagggcgaggccgacgcctccccccagggtcagctgcgggctcccaggcctaggcgcccatgacccctacgccaaccgccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57583 - DNA, 2241 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcgggctcccaggcctaggcgcccatgacccctacgccaaccgccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggcccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttga

SEQ ID NO: 57584 - DNA, 2222 bp, Homo sapiens
ggggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcgggctcccaggcctaggcgcccatgacccctacgccaaccgccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtatttactatctttactaatgaacttcggggaacgttttcctctctataattatat

SEQ ID NO: 57585 - DNA, 299 bp, Homo sapiens
ggggaagagcaccccctggctgttgaggggtcagcgcagaggccgcggggatggagcatggctgcatgtgaaggaacgggaaggaggcctgcgtgcctggaaggaaggagcggtgagagatgaggaagagagatgaggtcagagaggtaagagggagcttaattttagggcctagttaatgtaaagactttagattttactgtgactgaagtatacaggattggagggttttgacaggagtgatgtaatctgagttttattttttccaaattttatgatgaaaaatttcaaacatacaa

SEQ ID NO: 57586 - DNA, 362 bp, Homo sapiens
ctattgctgagactgggagcttgtttttaaagacctggcaagggtttcaaacacccacatgcataaccaatgaagcaggttggaaaatctgaactatgctaatttcaccataattactcattgcttgaagtcttatgtatttgtgttttcttggtagtctctttaaaacatgtttcaatatgaaacgtatatgtattaaatcactccgcttagaattttaggaatatagttttgtttttccccctaaaagatgtagaatgcagcaggttctctaaagcacatgtattctttgttacgtgatttggttctttggaacttcttttatcatgtagctattaaagggtagctgtcagaattaccca

SEQ ID NO: 57587 - DNA, 465 bp, Homo sapiens
agacagttgtgagaaggtgcctgggaaggcgtacagcataatgaaagtgatgtttcagaggattctcctggctgcagtgtgcatgatggcttagaaggtggagtgagatggggagatcagcaaggaggctatggcaataagtcaagttaactaaatccagcacctgtctttttcttattttcccctgatgttgatgatacagtgcagaattcagcaatgcctaataccacagaatgtacatttcaatccttcatgctcttcctgtgcctgccctgtgttccatctagattctctcggccctccttgccagctcagcctgccatttggaggcctacttctttatcccccacctttagggtagagtcacatagaaacccttccaaccctgataaaaatcctcacatttaagaaccccagaaaagagcatatagggatggccgggtggggccatctatggaagtatgc

SEQ ID NO: 57588 - DNA, 407 bp, Homo sapiens
ctgtttgcaacttctccccgtacgcccaattcaacgaattgttatctctggaccactgggctcacatcgtgaacagctgctccaccctctgtctttcaccagcaagtttttctggtaacaagaccacataggtctcacttaagccatcttcaccaactaccaactattaaactggttaattcgtctttcagatcagaaacaagaggccaggagtaaaaactgtgccaatcagagaagaattacctggccaccaaattaccagtcactcactcatctcaactctcctccctggctcctttaccttgaagcttaggtctgcaatggttattttatatagaagagcaaaatatgctcctttcaaatttcacttttttttcttttttttgggcgtacggggagggtaccga

SEQ ID NO: 57589 - DNA, 203 bp, Homo sapiens
tgtatctacacctgtaatattgtgagcttcttatttctttacctcttttggggcagaatcatgtgtatccaacaaggtaaaagatatatgagaacttcaaaatgagaataaagtaccaaaagaattgcttagcttagttgaacagagaacacatatttagttgaaggtggtaaaatggttaacagaaattgatcatggacttt

SEQ ID NO: 57590 - DNA, 323 bp, Homo sapiens
gagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccaaaaggaaaatataaaagaaaataaaatctcacattggtgcttagcaggagaatttttaaagacttacaaatcaacaagctgttcaaataaataatgaatgctgcagctggctcttacatgggcctgagtgtccaatagtagcagatgtcccagttctataaat

SEQ ID NO: 57591 - DNA, 181 bp, Homo sapiens
cagtttccccaaagtaaggaaggctttagtaaacccctgtggcattcccctgtggtttgtaatgaaggcagacagcttagagtaaataatttcttgttttaggacctcttggttgtgatttaaattaaaaacgagaagatcctttcggtctgggcccccgtaactgttgtaattggagaga

SEQ ID NO: 57592 - DNA, 618 bp, Homo sapiens
aagacattttagtctttgaggttcatcccattctgttttaattttttcgagacaaaaaatgaccaatctcttatttgcgtattcaagcattcttaataagtcactaaaactcttatttttcataactctccttttattaaaaaccttggggaagagaacaaaacattccacattgaccttagtgagttgttcctaggtaggcatgatgaaaatgcaaaactgaaccccaaatctagccaactgaaagacattgatttttctagaacagcaccttccaaacaccagtctgtggaccagtcactgcttgcccaagacaaagttctcaccagcgtgaggtaaaatgaggaaaataacagcaatgtgtctaaattcattcaacctaaagacttcctttcattctttattgttgtccttcctatttctttgattatttgaacatctttacttctataaaaggaagttgccagcagatggtagttgttctcttttaacgtttctacttagtgaagttaacatttaacacacacctatgttggtcctcccacacccactttatttttttctcatccgtgaaaactagatatctagaaactactgctaggctaagggatagcttct

SEQ ID NO: 57593 - DNA, 336 bp, Homo sapiens
acaacacatacttgaaactgattatgactgtgtttgaatgcattttgattccttagctatgcctctcaggtgaaaggaccaatggcaagaggaagcagaggattcatgcactagaaaatactgagagagatcagagtattctgtctacttcactgaagatatggtctattgagggaaaactaattaacagttgatccaaggaacaaaagaatgctgttatgtgacattttgttgggaaactgactgtaataataataaaacaaatgtccagagaatgtgtcacataattacagtgtttatggttgataattcaaaggcatagatgaattggattct

SEQ ID NO: 57594 - DNA, 1611 bp, Homo sapiens
gactttcagccgagatgtgctagtttcatcaccaggattttctgtggtacagaacatgtctaagcatgctggggactgccagcagcggaagagatccctgtgagtcagcagtcagcccagctactccctacctacatctgcactgcctcccgtgactaattcctttagcagggcagattagataaagccaaatgaattcctggctcacccctcattaaggagtcagcttcattctctgccagtcagagctaaaaatagaaattgtgtaggagacaaaccttgttaattccctagaaatacattaagaggatagagtggaattttttttctctgcaatcttgcatttttttaatggctcttttttttttcctgataaaaacctttggtaggtagggaagttatgttttcaggggtaaatgtgctacttttgtcttctaaattttgctcttttttgactggtctagtcaagtgacagcccgattattttgctactccttaaaagtactattctgtctcttgggagtatggttgatggcaattccagttaactgctgtgcagctctcatctcattgtgcacacagcatggaaatctttctcaaaactgtttcactcaggtcagggtaacaagtttggtagagcaaaccggtgaatgatactctcatgcaaaactgaacagatatgcaaacatatgtatgtggttcagcttgggttgcatgggttcagactttgcaatgtgtagtttaataggtaattacccttaacgcttttgcagggaacccaactaccttgaagaaactttaatttttttgtgcttctaatttgtctccatgtcacatagccaaaatatagaatgttcaagtgttttctcctcaaaagtataattactagaatatactggtttttaaaataagtttatttttataaatttgtttccagaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatca

SEQ ID NO: 57595 - DNA, 1360 bp, Homo sapiens
tgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatca

SEQ ID NO: 57596 - DNA, 1016 bp, Homo sapiens
tgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacag

SEQ ID NO: 57597 - DNA, 1258 bp, Homo sapiens
tgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatca

SEQ ID NO: 57598 - DNA, 712 bp, Homo sapiens
ggccgcgggagcgccgggttttcgtagagcccaggtgcgcggtggtgcttgcattcgagagggaggggcgtggtaccggacgaggggggcggcgatggccccgagggcaccggggctgacgggacccctcgcccttgcccgcgtgtaggatggataaggtgggggatgccctggaggaagtgctcagcaaagccctgagtcagcgcacgatcactgtcggggtgtacgaagcggccaagctgctcaacgtgtaagtggggcccttgcgcgtcccccatggcaccccttcccgccccagcccgggaggtcgccttggctgggcgcccctcgcccggccgcgccacttcctgtcgcttttctgcctgtctcggaagggagggggcgagcgggccgggcggcgacccccagggacccgggcagggggttgagggcgcccgcgcttctgcgctcactggccccgcccgctgcccccagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacg

SEQ ID NO: 57599 - DNA, 1584 bp, Homo sapiens
tgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtgtaagtggggcccttgcgcgtcccccatggcaccccttcccgccccagcccgggaggtcgccttggctgggcgcccctcgcccggccgcgccacttcctgtcgcttttctgcctgtctcggaagggagggggcgagcgggccgggcggcgacccccagggacccgggcagggggttgagggcgcccgcgcttctgcgctcactggccccgcccgctgcccccagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatca

SEQ ID NO: 57600 - DNA, 1299 bp, Homo sapiens
  misc_feature (1178)..(1181): n is a, c, g, or t
  misc_feature (1185)..(1185): n is a, c, g, or t
  misc_feature (1188)..(1190): n is a, c, g, or t
  misc_feature (1193)..(1198): n is a, c, g, or t
  misc_feature (1200)..(1201): n is a, c, g, or t
  misc_feature (1203)..(1203): n is a, c, g, or t
  misc_feature (1221)..(1221): n is a, c, g, or t
  misc_feature (1225)..(1225): n is a, c, g, or t
  misc_feature (1229)..(1231): n is a, c, g, or t
  misc_feature (1270)..(1270): n is a, c, g, or t
tgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaaaaaaaaaaaaaaaaaaaccacccccccccccccccccccccccccccannnnaaancannnaannnnnnannantcaaagagaaaaaaaaangggngggnnntttaaatattttatgagggggggaatttttttttttcanaattttttttttaaaggggattttttaaa

SEQ ID NO: 57601 - DNA, 897 bp, Homo sapiens
caggcacccaccaccacgcctggctaattttttgtatttttagtggagatggggtttcaccatgttagccaggatggtctcgatctcctgaccttgtgatctgtccgcctcagcctcccaaagtgctgggattacaggcgtgagccaccgcgcccggcccctttcttctattttctttatcctggtagtagacaaagaatgttgcctatttgacctatgtccagagaaggcagagtgtcagtcacactgggtttctatccagccccagtcctgtccagtgggtaactctcagccccactcctcatcccccaaaggccccagtgacctctatgctgcagaggtgcactgggtgggccctagagctgggctgcagagcaagcaactggctgcatgcctgggcctccctgcgcagttcctcacatgcatgctgtggtcccagcctgacctctccatctggagggggccgcctcgctgggctgttccaaagctggagtcctggtggcagctgctttgccaagtcgcgcagtagccagggcttgcctgcagcccagaacactcagacagggtcaggccttccagggttcacagcacgtcccatgcccctatgtcctggcatctggggaaaagctgtcactggccagacgtggagtggcttcctgccctaagctggcaggctgtcctgcctcacatgccagagccaagaccggcaaaccccagctgtcagggcagggaagtgggcaagggggcagcaagctgctggtgtctatgccttgactccgagataaatagatgacctaacagtggccaacttttgcctctcacctttctgacggtgaaatggaatcgagccccagacctgaccagggtacagtaaaaggtcttcctttaaacacaaaa

SEQ ID NO: 57602 - DNA, 393 bp, Homo sapiens
ttgcaacagaaaagataaaaaatgcttactgcttcaccttttgcttctggctgcagaacaagtagaaaggagcaattacacccaaaacgttaaaaaaaaaaaaaaagcaattaggctaaaggctgaggaaatgatcataacatgatggaagttccagcagccaagatgaatcagaaagtagctatgtagcctatcatgataggaaagctgggcatagacatagatcagtgttttccaaccaagtgtgggccaggagtggtgtcacgcctgtaatcccagctactcatgaggctgaggcaggagaatcacttgaacctgttagatggaggttgcagttagccaagactgtgccactgcactccagcctgggcgacagaccaagactcagtctca

SEQ ID NO: 57603 - DNA, 5340 bp, Homo sapiens
cggctgctcgcgagctgctttctctcctcttccctttccgggtgcacggcgaggagaaagtctctatgcaactaagccccggcgcgcacttggccaggtatgtaccgcgggagcggcgcgttctgcgcggaagcagatgctgctgccgccacggcggcggcggctgccagctcctgagctctgtaactgtcacactgcacctgagctgaacttgaaaagagagtgaaggggcgattgggcgaacgcttttggcagacacagagggtgtttgtagacgtgggggaggagaatctctattaacgccccccaccgtaaccactgcacatcacctccatctctgcaaatacagcccgaggagtagaggcagcagcagctggacccccaaagagagacgtggggcagcggctgtgaccgcatctcctgagctacaacaacaggtcgcctttttgagactcctttggcgggaagggctacttggaaaggaaggtttgaaagagtgagaagggtaggtgtaagggttccctaattcgtcgaaagaattctattgggtgactctcgttcgtcttctctatcctacactccacatactgaccctatattatccagactgtgccggggagaaatcaaaaacacctgtttgaagaaacggctgcacctgtgtgcttatttgtgccagagggtggcctagcccacctgcaggaagagatttggctgggttctgttgagggtgattgttaggacgttgtattttgttgccattattccaaatacctgtcttggagggaaagttgcccttctgagaactgtgactttaccaggagccctatcttggaataagagttacacctctggaccacgtttctcactagtactttgcttgactggaggaagtgggtgacttttggctgcttcggtgacccattgtagacgcctcgttacccttcttccttccgcttcaagtaatcatggcggcgggggtggcagcgtggctgccttttgcaagggcagcggctatcgggtggatgcctgtggcctcggggcctatgccggctcccccgaggcaggagaggaaaaggacccaagatgctctcattgtgctgaatgtgagtggcacccgcttccagacgtggcaggacaccctggaacgttacccagacactctactgggcagttctgagagggactttttctaccacccagaaactcagcagtatttctttgaccgtgacccagacatcttccgccacatcctgaatttctaccgcactgggaagctccactatcctcgccacgagtgcatctctgcttacgatgaagaactggccttctttggcctcatcccggaaatcatcggcgactgctgttatgaggagtacaaggatcgcaggcgagagaacgccgagcgcctgcaggacgacgcggataccgacaccgctggggagagcgccttgcccaccatgactgcaaggcagagggtctggagggccttcgagaacccccacaccagcacgatggccctggtgttctactatgtcacggggtttttcattgccgtctctgtcatcgcgaatgtggtggaaacagtgccgtgcggatcaagcccaggtcacattaaagaactgccctgtggagagcggtatgctgtggccttcttctgcttggacacggcctgcgtcatgatcttcacagttgagtatttgcttcgcctggctgcagcgcctagtcgttaccgttttgtgcgtagtgtcatgagtatcatcgacgtggtggccatcctgccttattacattgggctggtgatgacagacaatgaggacgtcagcggagcctttgtcacactccgagtcttccgggtcttcaggatctttaagttttcccgccactctcaaggcctgcgcatcctggggtacacactgaagagttgtgcctcagaattgggcttcttgcttttctcgctcaccatggctatcatcatcttcgctacagttatgttctacgcagagaaggggtcttcggctagcaagttcaccagcatccctgcagccttctggtataccatcgtcaccatgacaacactagggtatggtgacatggtgccaaaaaccatagcagggaagatttttggttctatctgttcgctgagtggggtcttggtcattgctctacctgttccggtgattgtatccaacttcagtcgcatctaccaccagaatcaacgagcagacaaacgaagggcacaaaagaaagctagactggccaggatccgggcagccaaaagcggaagcgcaaatgcttacatgcagagcaaacggaatggtttactcagtaatcagctgcagtcctcagaggatgagcaggcttttgttagcaaatccggctccagctttgaaacccagcaccaccacctgcttcactgcctggaaaaaaccacgaatcacgagtttgtggacgaacaagtctttgaagaaagctgcatggaagttgcaactgttaatcgtccttcaagtcacagtccttcactgtcttcacaacaaggagtcaccagcacctgctgttcacgacgacacaaaaaaacttttcgcatcccaaatgccaatgtatcaggaagccatcaaggtagtatacaagaactcagcacgattcagatcagatgtgtggagagaacacctctgtctaacagccgatccagtttaaatgccaaaatggaagagtgtgttaaactaaactgtgaacaaccttatgtgactacagcaataataagcatcccaacacctccagtaaccacaccagaaggagacgataggccagaatcccctgagtactcaggaggaaatattgtcagagtttctgctttgtaagacaattggaataaggtctaagagaattcgagccctggctgtgaaaagaatctcaacatagaagaaagaagaaacaataaatattctgcagattaatgcagcaaagaaagaaggttggtagtgaaacacaaagcttccaatcttaaggatgtgaataaaaccaccaaatggcatttctagacagtttgacctgttatacagagtaatattctgtggccctttgactttgtgaatgagcacaatgaaatgccgcctactgatgcttcttatgatcagaactcttttttaataaaataaataacataaatcgttgaacataatgttccagttgaatgcaaaacaaaaaaaatatggaaaacattttgataaaattttttcctgttaaaaccatgaacattggctatgatgaagattattacatatgaaaaaaaaactcacacaacatatttgtattgactgaaggaaaccatcataatgcatgctagaattctttgaagcagtgatctcagtttccttatgttgtcttcagaataggcatgataaactataattgtagaaaggggtaatttctgtgcacttacaacaagctgagtgttcatgttccatggtgggctgtgcaaataaactccttttagacctgcagtatttctcatggggatgctcattagtaaatctaaagtgttcagatagttcagtattcattatcgtttaactttgcacctagatactgttacaactgcaataatttgttgtacaactgttgtatcaggaatcaggatttttttgttgttgtactttccagatccttatagatacggtaagagccacattcgtagaaaaacttctggtgtggccaggttttaggtaactttttaatccaaaactattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgacccatataaattatctctaacgtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccactgtaaggaataaagcttagcttctgtacatggaaagagctaataattatccctctgtcagagatgagatttttaaatgcttatgatatttaatcataaaaagggattaatccaaccattttcaagtaaagccagaaattcttgcttcccatttctagaatagtttctagaacagtgctatgcacatattagatcttaataaacatttgctgagtgaaagtaagataaactcaactatctcttgggaagaactggcttcattcctagtacatcttttaaaaagttactaattttccagcagtacaaatattaacaattatattaacacctgcctcatgtcagtttatgcttctagagcaatgtctagtgaaacttatctgatggcatttattgaaaaccttctaaaaagtagactaaggaaaccataatcagaattactatgtcttttgattcccaatgagaagttctattttcatgttcttaatattacatacaagaaaatgcagttaggttatttcaattgacaattctgcctcctcttttgatttatcacttacccaaaattattaattttattaggcttttggaaaagaaaaaaaactttttgatgttttaggtgatttaaaaatataccgtgttggtggtgaatgactattgatgactgtgttaagtgcatctgtattgtaagtgaaatgtaattatttctgtgtaccatatggagtaactaaggtcattgtttttgacaattttgtttgaaattcatatatcttatttcaaaggatagcataatatctgcattatgctggaaaaaaatagacctttggagaatacttaaataaaacatgtgcatgcttgaacaggacaaaatgt

SEQ ID NO: 57604 - DNA, 1521 bp, Homo sapiens
aggtgaatgtccccccagttatagggtgatgtcccccagttataggtgaatgtctccccagttatagggtaagtccccacagttatagggtgacgtccatcagttatagggcaatgtccccccagttactgggctgtgtcccccaattacagggcaatgtcccctcatagtgtctcccagttatacagtattgtccccccattataaggtagtatccccagttactagatagtgtcccccagtaacaggataatgtcccccaattgcagggcaatgtcccccattatagtgtccccaagttataagctggagtcccccagtaacaggataataggatagtgttccccagtacagggcagtgtccccagttactcactagtgtcccctagtaacagggcagtgtccacccagatacagcctagtgtccctcagttacacaatagtgtgtcccccagtggtaggacagtctactactgagtcctcctggcatgagtcgagctgagattaggatagggtaatgacccttcagttttggggaagggaccagagctcggccagtgagaagcttccagctccgtctggccatatccaggctgctgagggtcctgggctctgtccttaaacctcatcactgacatgacccagcaaacctcctcaagaggaaaaagtccccttgggtcaaacacagcttgtgcagttctcggggacctcctcctgccatcctggggatgctgtggagaatggagatgcacagggggctttgtcctctcctctgccttttggagaaaatatttcactcaaggcaaacgcagcctgagggcagcacaggggaccccaaggctcactgcgcatttctagtcgcccccaaacgcgtgggttttcctcctgttctcctcgtgggtgcctttgctcattctcatcctcctgttctcatccagtctgcccagtctgaccggctcccagcagcatccgcccaaaagtttctcccatgacagcaggaagcagcctcagacaatacatgatggacaggcctggctgtgttccaatagaaccccgagtcagtcagcccgagcctccctctcagctggatactgttaatgacaggggtacacattcccctcccctttccaatgttttaaaactctaggacagtgattctcaaacactttggtctcaaaacccctaagagcatttgcttatgtggcttttatctgttgatagttgctacctgagaaattaaaactgagaaatctaaaaatagatttattttaggaagtcactaaaaataataagcccattgcatgttaacatgaaatagcatatttttacaaaaaaataaattttctaaaaacaaaacatctaagtgagaagagtggcattgttgtacttgttttgcaaatcttttcagtgtccggtttatgagatgacagcactttggtttgttgccaaccattcacttataaagaaacccttttccaataattagctggggctggtgctagagcaataccagaagttcag

SEQ ID NO: 57605 - DNA, 274 bp, Homo sapiens
ctatgaggaccagcaattagattttatagcagtacttcccattaaagtgaataaccaaaatcactttaaggtcaagatcttagtcaatacattatgtaaaaacatatacaacagacaatacaccagaaactaaatcttttgcaaccttttaaacttatgatgaaaaacattaatgtcagctctaaaatgtattaagcagtttttacaaaaaaaatgtatagaatacaggagccaaaacatttaacaattaccctaacttgctgacacagaatac

SEQ ID NO: 57606 - DNA, 230 bp, Homo sapiens
cttgaactcctgaccacagatgatacaccaaccttggcctcctaaagtgctgggattacaggtgtgagccaccacgcctggcctacattggcatattttgtctatttatatttaatgtaattattaatatgtttgagtttaaagtcttctatcttactatgtattctggatttgtcccatcttttgtttctcttttcctttcctgtcatttgagtgaactagctattttt

SEQ ID NO: 57607 - DNA, 515 bp, Homo sapiens
cttgactggtctgtcttgtggaaccccacagcatctaggccagcagttcctgtgtcctttactgcctaaatgttataaatcttaaataggtaaagaggagaagttttgtggaaaagatgtggtttgtggataaagaacactgagtttagagttttcaatttgggctctaaattttgaaatagactaatagaattgtgtccttagacaagactaccctctataaaatggtggtgacaggccaggcgcagtggctcatgcctgtaatcccagcactttgggaggccgaggcaggcagatcacctgagggtgggatttcgagaccagcctgaccaacatagagaaagcccatctctattaaaaatacaaaattagctgggcgtggtggcacatgcctgtaatctcagctactcgggagactgaggcaggaaaatcacttgaaccggggaggcggaggttgcggtgagctgagatcacaccattgcactccagcctgagcaacaagagcaaaactccat

SEQ ID NO: 57608 - DNA, 972 bp, Homo sapiens
gacccgctgcccctgtgggagcaccctgcttcaggaagcctccctccctccctctgcctcccttccccaggacaccaagagcgccctctcctgagccctggcagaccgactgcaggtagcaggattgcaggaccctctgcctggcctggcgtttcaggagagaggggaagtggggcctgtgctctgggaggcgtggtcatccgagacaggagtccaggggagagaggaggggacaaaggcgccgtctgggggaggtcgatgagcctgtgctggcatccgcgggccccacgctttgccaactcctccagccacaggcaaggccacggctccgggctgttgcgctctaagggttctgtgattggatggaacagagctgctggggaggagactggaagtttctgcattccttcaacagaacatttaatgaagtactctatatatatatataaatatatatataaatatatatatatacttctatttgtgggtactttaggaaaatgccctttggtcactgtaaatatgaattgtgaccccatcccttcccgcatgagcccagtgagtcccagcagctatcagcctccctgaacgattaaacagctcctcccagcatttgcatttgcccttctgtttctgtgaggccggcagcccttggggctggggagagcacagcttgccttggacttgcttctgaacacgaattcttcgagaactaggctcagatgctctgctggagtgttggcctcaccccagtccccttgccagcaacatcactgcccttggacgagactcagtggaagacacttcccctcggacccgttcccaggaggtgcaggggcccagcaataaacggcgaaaggggccttggctcttgccctgtggcagtgaccttggggtccgtactatgcccaggtgtcagcaggaaacaaggccttgctcacaggagcacaggctgtaccaccacaaggagcc

SEQ ID NO: 57609 - DNA, 888 bp, Homo sapiens
ctgtcagcgggtatcgcgagcgaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcacagaggcccttggacaacaaaatacaaaagaagcaaaaaaaaaaggaaagaacacaaacaacaagaaaagaacaaaagaacacagaaaaagcagagacacaacaccaaaaaacaaaaagcacaaaagaaaacagcaacacaacaaccaaaaaaaaaccgaacagaaagaacacgaagcgagacggaaacaagcaaaaaaacaccacagagcaaacaagcgaaaccgaaaaagaacaggcaacgcaaaacaaacagcacgacgaaaaccaaagaaccaaggacaaaaaaaaaaaa

SEQ ID NO: 57610 - DNA, 676 bp, Homo sapiens
cgggaacacagcgcctgtcccgaagcggactcaggcatacaggtaagaacatgtgcccttccccagacatcccccccaagccgtgttagattcaaggcaactgtggggaaccgacttacaaccctaccctgggcggggacctaagaccatctcaggaggggcagggcatgtgtgcatgtcttgtggaagtgagcacacccggtgtgcacactcatacacatgtgcacacacacgcactctccccgcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57611 - DNA, 365 bp, Homo sapiens
cagtagagcctgaagacatagcccaggatcttcagtgttctggggcagccaaggaaacttcctcaggctccacatgccttcctgtttgcattgttttcagctgaatttcaagaggctgtcagagcaggcctgccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacgagtgcctgtggggtgtcaggcag

SEQ ID NO: 57612 - DNA, 3172 bp, Homo sapiens
cgactggtataaccacggttgggcccaaattgaggaccaaggtgaaaaagcagccggaacgcggcagaagaaggtcctaaggagcgagctgggcggattcggccaagccgggcgttcagcgggccggccttcacagcccgccggagccagatgccgccccctccgccggtccctcccccggcggctggcgcctccctccctccccaccgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57613 - DNA, 2844 bp, Homo sapiens
tcccagaggtgtgggtgcaggtttcctgggcttgccagacacacagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57614 - DNA, 2707 bp, Homo sapiens
aggggacacaggcatagtgtaaaccccggctgaaacgacggcagtactatacggtctaggtagcgaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccaggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57615 - DNA, 3407 bp, Homo sapiens
cgactggtataaccacggttgggcccaaattgaggaccaaggtgaaaaagcagccggaacgcggcagaagaaggtcctaaggagcgagctgggcggattcggccaagccgggcgttcagcgggccggccttcacagcccgccggagccagatgccgccccctccgccggtccctcccccggcggctggcgcctccctccctccccaccgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggttaacaacacgcgacggaaagaaaaagccgagaggccaccaccaatgcaggaggatgcgggaccaaacacgcaggggcacccgaaagcggggcccgacggggccagataggtaggttgccggggaaccccaagacgacccaggccacacaaagcaggccacgactccaggggagtccgccccgataagaggaaccggaataacgtccgaacagacccagggtaaccccgcgcatcag

SEQ ID NO: 57616 - DNA, 1391 bp, Homo sapiens
aaacataggctagtagagccgggtaaatcggacgagggcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57617 - DNA, 1994 bp, Homo sapiens
cgactggtataaccacggttgggcccaaattgaggaccaaggtgaaaaagcagccggaacgcggcagaagaaggtcctaaggagcgagctgggcggattcggccaagccgggcgttcagcgggccggccttcacagcccgccggagccagatgccgccccctccgccggtccctcccccggcggctggcgcctccctccctccccaccgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctgtctgctgccagcacagtaggtcccggccagctctggagttctctcatcggaggcccatgccctccactccactgcctttggaagggtctctctccaggtcagcctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggttaacaacacgcgacggaaagaaaaagccgagaggccaccaccaatgcaggaggatgcgggaccaaacacgcaggggcacccgaaagcggggcccgacggggccagataggtaggttgccggggaaccccaagacgacccaggccacacaaagcaggccacgactccaggggagtccgccccgataagaggaaccggaataacgtccgaacagacccagggtaaccccgcgcatcag

SEQ ID NO: 57618 - DNA, 3037 bp, Homo sapiens
aggggacacaggcatagtgtaaaccccggctgaaacgacggcagtactatacggtctaggtagcgaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggaccgacagacttgacaacggtgacagcactggggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57619 - DNA, 2842 bp, Homo sapiens
cttgtgacccatcaggagtttttgtcccgataccgtttcccacaggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57620 - DNA, 2918 bp, Homo sapiens
aggggacacaggcatagtgtaaaccccggctgaaacgacggcagtactatacggtctaggtagcgaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57621 - DNA, 2736 bp, Homo sapiens
aggggacacaggcatagtgtaaaccccggctgaaacgacggcagtactatacggtctaggtagcgaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57622 - DNA, 2348 bp, Homo sapiens
cgactggtataaccacggttgggcccaaattgaggaccaaggtgaaaaagcagccggaacgcggcagaagaaggtcctaaggagcgagctgggcggattcggccaagccgggcgttcagcgggccggccttcacagcccgccggagccagatgccgccccctccgccggtccctcccccggcggctggcgcctccctccctccccaccgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaagggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 57623 - DNA, 1089 bp, Homo sapiens
cgactggtataaccacggttgggcccaaattgaggaccaaggtgaaaaagcagccggaacgcggcagaagaaggtcctaaggagcgagctgggcggattcggccaagccgggcgttcagcgggccggccttcacagcccgccggagccagatgccgccccctccgccggtccctcccccggcggctggcgcctccctccctccccaccgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctctcgaggtgggaccacggggagggttctataaaaagattttttgcaaaagtgcgagcacattatgtagaaaccacaagtccgccaggactagtaaaagccagactcccactgaggccactaatcctgaaggaatgaggagggagcagttacccaaatcccgaggtggagaaggctgtgtggaaaagagggtccccctctcggagctaagacctcaggggagccagcccgagcatcccctgtcgggacctctagaacgccacc

SEQ ID NO: 57624 - DNA, 570 bp, Homo sapiens
aggaagctatttgtgcttatgtaatgatatgggttgcaaatgatttttctaagtgtttaatttactttttgatttttttttgcatatagagtttctgattattatatagttaaatatgtcaatatgaagtccagaaatcttaaaaactcttagttagaaaagcttttaccacttgaagtgataaaatgttttttgtatcatttcattcagtgcttttatttaattaatttttatttttagagacatgtcctgctctgtcacccaggctagggctcagtggcatgatcatagctcactgtagccttgaagtcctgcactcacatgactctcccgccttggtctcccagaagtgctgggattacaggcatgagccaccacgcctaacccatttagtgcttttataagttttattttagactcattttatgacttcagttttacatttaaatcttagactcatttggaaatttttttatggtatgagggattgattgatgattttttttcccccagatatttgaatatagctatccctaaacttattttttttttagacaggatcttgcactg

SEQ ID NO: 57625 - DNA, 309 bp, Homo sapiens
gaccccgtatggatgtgatggccccttgccatcatgggtcactgaagggcagctgcaataaccctcatccagttctgccctctcaataatctctggcactgcctgtgttttctcttattcaagtgagggcaagcaccttctagtccacaggggttgggcacagactgagacacgaagtcatgtgccttagaaaggtcaaggttggttcataggcctcttagagcaaagaagggcaggagagaaagaaaaactagcatttattgaaaacttagaatgtggtcaggcacagtggcccacacctatcatccc

SEQ ID NO: 57626 - DNA, 343 bp, Homo sapiens
cagcaggctggttgggacccattgagaaggagctggtcagctacaggtaggagcctaaaccttgatcctgtgggcactggggagccaaggagggcttcaagcagaaggaggtgccgtcggctctgtgtgaggctggaaaggaaggtgggcacctgctctcaggcttcacctcctgtttcctttgattcacaggtccgtcagagccgccccacaccttggttgggctccccaggtcccctccaccttggcctgagccagggatgggggtggggaaggctctctgtggccacaacaccgtgcaacacccagggaggaagaggatgtggttgtcagggaaccggct

SEQ ID NO: 57627 - DNA, 300 bp, Homo sapiens
ctgaaactttgtacactttgcccaatacctcccctcctcacagccccacccccagtccctgagagccaggcttggaggagaccaaatgccttgaaatagctggctccagcctttctcttttcctgcttccagccaggtcctggagaactcaaatctcgctgatttgggatactacaaatccatgcacttttccatgccagttcttactcaaactcaggggttctcaacctcggcactcgatattttggtggagatatttctttgccggtgaactcttgttttctgcctggtgcctctcag

SEQ ID NO: 57628 - DNA, 3658 bp, Homo sapiens
agcggttgagtaaccaagataattattttcccccttgctctctatattaatacgtagctataaagcaacagttggttttcttatcctttgataaaagcatcccataaaatataaagtagtaagttaacatagtattattgtcacacacaatgctttttttggttaaatgttgatacgaagcaatgttttggaattactttaattgatggagtagtggtggtagagagaaattaataacaaaaagagtgaaaatattttaattagcagtagatggtgctactggctttcatttgctgacttgattattccctttctcttaaaaaccatggcattagactgcactaaattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatactttgtttacccctctctgagacaggtttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcaggaaaatcagtttcatcattttagttacactaaacacttttggcagcttaatatgacctttttaaattttttttattttttttatttttatttctttaagatggagtcttgctctgttgcccgggctggagtacaatggcatgatctcagctcactgcaacctccacctcctgggttcaagcatttctcctgcctcagcctcccaagtagctgggattacaggcagcaccacacctggctaattttcatatttttagtagagatggggtttcaacatattggccaggctggtctcaaactcctgacctcaagtgatccgccctccccagcctcccaaagtgctgggattacaggtgtgagccaccacagccagccagtatgacctatcttaatcatcagctcaactgtaatttaaatttggctgttctctggagctaaaccattagggaagttcaaaggaatgtgccatgatttccgaatttgcacaagagaatgttttaagcattggtagcatcattgaataaaagaatagtttcctgatgtcactattttgaagtggaaattatcacttggatgtggaggttttactttttaaaaacattcagcttaattaccttaccttaattaccttagttagatatactaatggaaaaaaaccaagtcctttctctagaacttgttttctatttttgttccttttcatgaaaacttctcaatttaattttaactactgtaggatagtattgattgaatggatactatggaaaagtggatccaatatttaagatagaagtagtttaaggagacaacagcctttactgccatttttttttaaatgttttcactcagatgaacaatttgactttaataaaagactggagatttttgtacaaagaaataggaataagtttcatatactaattatgctgagttttaagcctacatatcacaaaatatttagaattgtataaccttttcatatatttataacttttaatgtctttttaaaagatgtgggaccaaaaatatatttataatttggaaatgtgactgcataccaataagaaaacttaccttattttgaaatttatctgggatattaaagaatctaccaattcttaaaaacacagatttatactttaagcttattttaaaattaaagaatatataccaattcttagaaacactttaaggactactcttaaataacttaaatatcagagttttgttgtaatattaaaatttaccatggaaatcactgttgttcagctatcaccttaattgtgtatgatatgataaatgtttagcagtaaagctatcttaagatttaatggaaaagtttaatttgaagatgtaacaaaaattctgaccacagttgattctgaatttttaaggctttcctaataggctgatcacagagaataatccattttgaaggtataaaactgcactgtatgtctgtcacttgtagctgaactgattcacattttgacaaaagagagaaaatacaaaaatgagttttgcaaatgtaataactttttctgcatatagaactaaataattgaaaaatatgggctatagttctcaaaggtagatagtaaaatcactggctttttccagctgtatgtttttccactgtgcgtgtacacacacactggaaaataattaggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtggtgagggcactaatcttgtaggaaacacttacttgatgttttatttgaacttttcctataggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatgggatgggaaatatttaaattctaggtgtttttttttttttaaagaagaaactcaatgtttataagaaaaaaatgaataaatagttacgtttggccatgaa

SEQ ID NO: 57629 - DNA, 3693 bp, Homo sapiens
agcggttgagtaaccaagataattattttcccccttgctctctatattaatacgtagctataaagcaacagttggttttcttatcctttgataaaagcatcccataaaatataaagtagtaagttaacatagtattattgtcacacacaatgctttttttggttaaatgttgatacgaagcaatgttttggaattactttaattgatggagtagtggtggtagagagaaattaataacaaaaagagtgaaaatattttaattagcagtagatggtgctactggctttcatttgctgacttgattattccctttctcttaaaaaccatggcattagactgcactaaattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatactttgtttacccctctctgagacaggtttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcaggaaaatcagtttcatcattttagttacactaaacacttttggcagcttaatatgacctttttaaattttttttattttttttatttttatttctttaagatggagtcttgctctgttgcccgggctggagtacaatggcatgatctcagctcactgcaacctccacctcctgggttcaagcatttctcctgcctcagcctcccaagtagctgggattacaggcagcaccacacctggctaattttcatatttttagtagagatggggtttcaacatattggccaggctggtctcaaactcctgacctcaagtgatccgccctccccagcctcccaaagtgctgggattacaggtgtgagccaccacagccagccagtatgacctatcttaatcatcagctcaactgtaatttaaatttggctgttctctggagctaaaccattagggaagttcaaaggaatgtgccatgatttccgaatttgcacaagagaatgttttaagcattggtagcatcattgaataaaagaatagtttcctgatgtcactattttgaagtggaaattatcacttggatgtggaggttttactttttaaaaacattcagcttaattaccttaccttaattaccttagttagatatactaatggaaaaaaaccaagtcctttctctagaacttgttttctatttttgttccttttcatgaaaacttctcaatttaattttaactactgtaggatagtattgattgaatggatactatggaaaagtggatccaatatttaagatagaagtagtttaaggagacaacagcctttactgccatttttttttaaatgttttcactcagatgaacaatttgactttaataaaagactggagatttttgtacaaagaaataggaataagtttcatatactaattatgctgagttttaagcctacatatcacaaaatatttagaattgtataaccttttcatatatttataacttttaatgtctttttaaaagatgtgggaccaaaaatatatttataatttggaaatgtgactgcataccaataagaaaacttaccttattttgaaatttatctgggatattaaagaatctaccaattcttaaaaacacagatttatactttaagcttattttaaaattaaagaatatataccaattcttagaaacactttaaggactactcttaaataacttaaatatcagagttttgttgtaatattaaaatttaccatggaaatcactgttgttcagctatcaccttaattgtgtatgatatgataaatgtttagcagtaaagctatcttaagatttaatggaaaagtttaatttgaagatgtaacaaaaattctgaccacagttgattctgaatttttaaggctttcctaataggctgatcacagagaataatccattttgaaggtataaaactgcactgtatgtctgtcacttgtagctgaactgattcacattttgacaaaagagagaaaatacaaaaatgagttttgcaaatgtaataactttttctgcatatagaactaaataattgaaaaatatgggctatagttctcaaaggtagatagtaaaatcactggctttttccagctgtatgtttttccactgtgcgtgtacacacacactggaaaataattaggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtggtgagggcactaatcttgtaggaaacacttacttgatgttttatttgaacttttcctataggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatgggatgggaaatatttaaattctaggtgtttttttttttttaaagaagaaactcaatgtttataagaaaaaaatgaataaatagttacgtttggccatgaaaaaaagtcgacgcggccgcgaatttagtagtagta

SEQ ID NO: 57630 - DNA, 531 bp, Homo sapiens
gctggcccagttctgcagccctcataaaatacacccatgtcggtcgggcgtcgctgcccggcgcactgccttgcagcagggaccttttcgagcttattttcttcggtaggaaacacgaaaactagccactgccccgtcgtgttttttccttgcgtaaaagaaaggggctccttactacaggtcggccaccggctcttcaggtacagagatctgaacttggaaagacctgcctttctaaagggagtgataatgaacactgcggcgtaagtgtcccaggatttaaaaccgaaactccaacaaaaaaaaattttttaaactctgctactagcaagagcacattgtgtaaaacactgacacgggacatggtttaaacatgtcaacattttctaacattgggatgaagtggtgtctacctcccgtcccgtgaagcgtcagggcaccgaccacacggacccccctccgtggagctcacggccctgtgctcagctctgctaagaccagcgagttttccagagctgggggagcccggtt

SEQ ID NO: 57631 - DNA, 191 bp, Homo sapiens
agagtcatcctaacccctaggacctagtgacaggggcaaagttggagtaattaatttagaagggggctgactggttttccacctctccaattacacatatttgatttgcctatcctgtctgacgttttaattgttagtttatactggtttaatctgaaatatttaagtatatttgctttgataatcttaac

SEQ ID NO: 57632 - DNA, 1528 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57633 - DNA, 337 bp, Homo sapiens
gcctactactactaaattctcccccctcgacgcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57634 - DNA, 671 bp, Homo sapiens
gggtcggggcctcagtgctgctctgcctgtcctcacgccttgggtggcgctgggcaccggccttgtgcgccatggtgggcgctgaagttctgggggcacttatggcgcaggctcggggtgctgttctagcttcaataggagggagactgttgcagcctcagagcctccgcctgcatcccctgccctcgagggcactggcattctgtctttgggactgagggctgcaggtggactccggaggagggtgataagcccagggtcctgggacaccctctcacctgcacagatgggtcctgagggtccagagagcagagctccctgcaggaacccaggatgcaaagctgacgtttttctggggggactgaactgggagactttgcgactgcattcgtacagtactcctggcagccctgcagaagaggtgctgtgagcccgttttacaggcaaggaatccgaggcatggagaagttaagtggattgtggcacagctgaggcgctgtcctgggcagcctggttctgtgtgtgtggcctcaaggggccagagtgaggccggcttcctcctgggctcagtgcccctggatgggaggtgggcatgaacaggactggcacccaccacccacccgggctcagcacagcagctgcagccccgtttcacatgaatagcgcatcgc

SEQ ID NO: 57635 - DNA, 1469 bp, Homo sapiens
cgctggtactggtctggagtttttgggatctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57636 - DNA, 3554 bp, Homo sapiens
gggtcggggcctcagtgctgctctgcctgtcctcacgccttgggtggcgctgggcaccggccttgtgcgccatggtgggcgctgaagttctgggggcacttatggcgcaggctcggggtgctgttctagcttcaataggagggagactgttgcagcctcagagcctccgcctgcatcccctgccctcgagggcactggcattctgtctttgggactgagggctgcaggtggactccggaggagggtgataagcccagggtcctgggacaccctctcacctgcacagatgggtcctgagggtccagagagcagagctccctgcaggaacccaggatgcaaagctgacgtttttctggggggactgaactgggagactttgcgactgcattcgtacagtactcctggcagccctgcagaagaggtgctgtgagcccgttttacaggcaaggaatccgaggcatggagaagttaagtggattgtggcacagctgaggcgctgtcctgggcagcctggttctgtgtgtgtggcctcaaggggccagagtgaggccggcttcctcctgggctcagtgcccctggatgggaggtgggcatgaacaggagaggcttccgagaatcagagtgtgctcagccaggaaaggcggaggccacctattcaggaaacggggctgcagctgctgtgctgagcccgggtgggtggcgggtgccagtcctcagttcaccggcctctgcagcttcgtgtctgcctcaccgggagacctggcagggccctccctaggcaactcctcccattcccagtgcccagtgcttggaagggagggccctcaggcagcccagacgttggcgggtggaggggggtgtgccagccaccgtccagctgctcttgttcctgcgacctcttttcaggaggaggaagtgggggatggaggctcctgggctggggaaaagggctaggaggggcctggaacccagaccctagagccagctttgtacctcaggcccctgcctttggcgtggtggacggtggggtatcagcacaggagcggggactgcctcactccccaggtgccaagttggcgggtgggcccaggtggacctgctggcacaggtttaatgtttaacgtgcccaagtcccggcccactgatactggaggctgctgccccaggttgtggagggtgtgcggtgcctggcgttggctcctgtgcccacctgccactgcggctgctggaactgccttgaaggaaggcggacagcctgagggccctgagtgtcaggttaccaaggaaaccaagccagccaaccaaggtctggagaaggatgatgccccgtgtggcccccgtggccctgcctgcagtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggtgaggctcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57637 - DNA, 1458 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctccccttgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57638 - DNA, 1436 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57639 - DNA, 1616 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcgggctgaggtgggctgagtgcccacttccagactgggccactggcacctcgagggcatggggaggacccagcgatccccccccacccaggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57640 - DNA, 1405 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctccctgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57641 - DNA, 1565 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttcaaaaaacaaaaaccacacaaaacaaaaaaaaaagggg

SEQ ID NO: 57642 - DNA, 1837 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttcaaaaaaaaaaaaaaaaaaaaaaaaaaaaaaaaaaaaaaaaacaaacaaaacacaaaaaaaaaaaaacacaaaaaaaaaaaacacacaaaaaaaagcaaacaaataaacgaaaaaaacagagggtcacaacaagagagcaaaaaaaaaacaacgaaaaagaggagggggcagagaaaggaagcacgcaccgagcagcgcagcagcaacgacagaacgcacgacaccaggaagagaagaacagggccggcacccacgagccacgaaaccacaagacgagggggaaccacaaagcgacaaagagagcgcaga

SEQ ID NO: 57643 - DNA, 1469 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggagaattaatttaattaaggatcct

SEQ ID NO: 57644 - DNA, 1459 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57645 - DNA, 653 bp, Homo sapiens
  misc_feature (115)..(115): n is a, c, g, or t
tgcttttcccaccacagtgaccgttacttcctccactgaagtcttgaacccctcaaggttacccatgaaggttagaatcaacttcttccaaactccttttcatgttgattcgtcnagcatcatacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57646 - DNA, 728 bp, Homo sapiens
tttccacctcccctggccaactttaccccaggccctgccaccctcacctgcacgctaaccttcacctcccccgccgccctgcaccctcacctcccctggccaacttcaccctgggctgtgctcccctgccaccccagggctgaggtgggctgagtgcccacttccagactgggccactggcacctcgagggcatggggaggacccagcgatccccccccacccaggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57647 - DNA, 593 bp, Homo sapiens
gtcttggtactctgaggatccgcgattaggaataacgcgcggacattttagcataccagcacaacgcgaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57648 - DNA, 2792 bp, Homo sapiens
gggtcggggcctcagtgctgctctgcctgtcctcacgccttgggtggcgctgggcaccggccttgtgcgccatggtgggcgctgaagttctgggggcacttatggcgcaggctcggggtgctgttctagcttcaataggagggagactgttgcagcctcagagcctccgcctgcatcccctgccctcgagggcactggcattctgtctttgggactgagggctgcaggtggactccggaggagggtgataagcccagggtcctgggacaccctctcacctgcacagatgggtcctgagggtccagagagcagagctccctgcaggaacccaggatgcaaagctgacgtttttctggggggactgaactgggagactttgcgactgcattcgtacagtactcctggcagccctgcagaagaggtgctgtgagcccgttttacaggcaaggaatccgaggcatggagaagttaagtggattgtggcacagctgaggcgctgtcctgggcagcctggttctgtgtgtgtggcctcaaggggccagagtgaggccggcttcctcctgggctcagtgcccctggatgggaggtgggcatgaacaggagaggcttccgagaatcagagtgtgctcagccaggaaaggcggaggccacctattcaggaaacggggctgcagctgctgtgctgagcccgggtgggtggcgggtgccagtcctcagttcaccggcctctgcagcttcgtgtctgcctcaccgggagacctggcagggccctccctaggcaactcctcccattcccagtgcccagtgcttggaagggagggccctcaggcagcccagacgttggcgggtggaggggggtgtgccagccaccgtccagctgctcttgttcctgcgacctcttttcaggaggaggaagtgggggatggaggctcctgggctggggaaaagggctaggaggggcctggaacccagaccctagagccagctttgtacctcaggcccctgcctttggcgtggtggacggtggggtatcagcacaggagcggggactgcctcactccccaggtgccaagttggcgggtgggcccaggtggacctgctggcacaggtttaatgtttaacgtgcccaagtcccggcccactgatactggaggctgctgccccaggttgtggagggtgtgcggtgcctggcgttggctcctgtgcccacctgccactgcggctgctggaactgccttgaaggaaggcggacagcctgagggccctgagtgtcaggttaccaaggaaaccaagccagccaaccaaggtctggagaaggatgatgccccgtgtggcccccgtggccctgcctgcagtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggtgaggctcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggtacgagagcaaagggggaagtcgatggggggatgtccctgcatgaacctctccctgtaagaagcggccggctgggcgcggtggctcatgcctgtaatcccagcactgtgggaggcccaggctgttggatctcatgaggtcaggagttcaagaccagcctggccaacatggtgaaaccccgtctctactaaaaatacaaagtagccgggtgtggtggcacacacctgtagtcccagctactcaggaggctgaggcaggagaattgctttaac

SEQ ID NO: 57649 - DNA, 456 bp, Homo sapiens
ccagcaagtatccccccagcccacccactgcccagcctgacacccacattcgcagaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcg

SEQ ID NO: 57650 - DNA, 380 bp, Homo sapiens
  misc_feature (10)..(10): n is a, c, g, or t
  misc_feature (23)..(23): n is a, c, g, or t
  misc_feature (28)..(28): n is a, c, g, or t
atagctgtcnagaggatcccggnagcanacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgacacggggatcctctggaacgactatgaccatgatagt

SEQ ID NO: 57651 - DNA, 1444 bp, Homo sapiens
  misc_feature (16)..(16): n is a, c, g, or t
  misc_feature (23)..(23): n is a, c, g, or t
tcaggctgtacgcccnggagttntgatatgtctaccacgcgctcgcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57652 - DNA, 2100 bp, Homo sapiens
ggtggcgtttggggtgtagagaaagcacgtatcattatcctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggtgaggctcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57653 - DNA, 1378 bp, Homo sapiens
tctacccgagaaggtgcttggaggtggggaagcagaaggggctgtgctggccagccctttatggacatgggttggggcgagagaccccactccttcctccccgtgcccggtctttggacgtttccctagcgcctcctcccttgccctgcctccactttccgggaagcactgcccctcacaggaagcgcccgcgctgtcaccatggcaatctgggagggagagggcctccaggcgtgtacccagtcctcaggctcctgggaggaacctgccagaagcggggaggccgggcctggggctacctcctggacggacccctccacctgatggcccctcaccctccccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57654 - DNA, 1586 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcgactgggccactggcacctcgagggcatggggaggacccagcgatccccccccacccaggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57655 - DNA, 1605 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctggtgagacccccgcttcccctgccccacggccctgtccctagcccagtgctctcattctaacctgtcctctctcgcagccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57656 - DNA, 1524 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtggtattttagccaggcccatatatactcgtcgctagtttggttgtgtgg

SEQ ID NO: 57657 - DNA, 761 bp, Homo sapiens
gtgtcgccgaatcgggatctcgcccttgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57658 - DNA, 1452 bp, Homo sapiens
gcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctggggcctcccctccactccagggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccggtcccacataggccgtctgcaagctgaggagcatggagagccagcccgagtctcaaagctgaacttggagtccgatgttcgagggcaggaagcgtccagcacaggagaaagatgtaggctgggaggcgaggcctgtcgtctccttttcacgtttttctggttgacattcgctggcagctgattagatggtgcccaccagatgaagggtgggtctgccttccgcagcccactgactctagtgttaatctcttttggcaacaccctctcagacacacccagcatcaatactttgtatccttcaatccaattaaattgacagtattaaccatc

SEQ ID NO: 57659 - DNA, 646 bp, Homo sapiens
  misc_feature (10)..(10): n is a, c, g, or t
  misc_feature (23)..(23): n is a, c, g, or t
  misc_feature (28)..(28): n is a, c, g, or t
atagctgtcnagaggatcccggnagcanacggcaacagatgctgtgcctggagcgggctgaggtgggctgagtgcccacttccagactgggccactggcacctcgagggcatggggaggacccagcgatccccccccacccaggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57660 - DNA, 558 bp, Homo sapiens
  misc_feature (10)..(10): n is a, c, g, or t
  misc_feature (23)..(23): n is a, c, g, or t
  misc_feature (28)..(28): n is a, c, g, or t
atagctgtcnagaggatcccggnagcanacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagacctgcggcttc

SEQ ID NO: 57661 - DNA, 383 bp, Homo sapiens
tagattatttcatgtgttataatactattggggttatgtttttaaaaagtgttatcttttagaaataaagtataaaagtatttgtagctgaagtgataaaatatctgagatttgctttaaaaataatcggggaatgtagatgaagcaagattagccatgtgttaatctttgttgacatggtgggggttcattgtacttttctcaatacttttgaatatatatggaagttttcactgtaaaagttttttaaaaatcacatctcaggccaggcgtggtggcttacgcctgtaatcccagcactttgggaggccgaggcgggcggatcatgaggtcagtagttagagaccagcctgaccaacatggtaaaaccctgtttctactaa

SEQ ID NO: 57662 - DNA, 157 bp, Homo sapiens
cttagatatttgccatctgggcctatacagaataagtttgccagctcctgcagtagaacaacagttctcaaagtgtggtccctgaccagcagcatcagcagtatgtaggaactggttacaaataccaattgtcagatcccacccagaattagacagt

SEQ ID NO: 57663 - DNA, 291 bp, Homo sapiens
gattctcatgcaaaaaatatatatattttctatcaccatcgaactagacactgacttcacagcaagagctactaaagctgcaggttaccattcaagtccccccaagagaaaaataaagtaaatcaaatgttacagcattcacagctcctaacttgcatttcctactttgctattgtccctgaatgttataatagcattttgacctttcacaagtggggaatgcatgaatgtagaaagaaggtcatttcgcacatttttctatgtggtgcacattcatgcacaggtgggtca

SEQ ID NO: 57664 - DNA, 516 bp, Homo sapiens
agccaacagcagcttgggtactcttccctcctgtgggtagtttgatctttataatcttgctgatgctcagtttttgtgtctgctctatgtttatgagctgtaacactcaccgtagaagtctgtggttttactcctgaaatcagcaagaccacgcacccatggggaggaacaaacaattccagacgtgccgcttttaagagttgtaacactccgtgcgaaggtctggcttcactcctgaagtcagcgaacccactgggaggaaagaacaactctgggcacgccacctttaagagctgtaacactgaaggtttgcggcttcacgccttaagtcagggagactacaaaaccgcaagggagtaatgaactctggtcgcgccacatttaaaagctgttaacactcacagcgaaggtctgcagcttcactcctgaaatcagcgagaccacgaacccaccagaagaaagaaactccggactcacaatcttttaggaactgtaacacttacttcgagggtctaa

SEQ ID NO: 57665 - DNA, 924 bp, Homo sapiens
cagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggacttcaacaacctcaatggggaagaccaagacattctgatggaaaataaccttcgaaggccaaacctggaggcattcaacagggctgtcaagagtttacagaacgcatcagcaattgagagcattcttaaaaatctcctgccatgtctgcccctggccacggccgcacccacgcgacatccaatccatatcaaggacggtgactggaatgaattccggaggaaactgacgttctatctgaaaacccttgagaatgcgcaggctcaacagacgactttgagcctcgcgatcttttagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaaca

SEQ ID NO: 57666 - DNA, 236 bp, Homo sapiens
ggtgatatgagataatcaggaattgtgttaaacattccctaattccctacttccagtgaaagattaaatttcccatggaaacacctaactaatactgttttataactaggtagactaggatagccttttccagctcacagagtgctttaatcctccatatactgttaagaggtagcgttttctccgttttgtggttcagaagactgaggcccagagaattcagggacatgccaggg

SEQ ID NO: 57667 - DNA, 477 bp, Homo sapiens
cagagggggaccctggagagcagggaagcacccatctattaaataattcacggcagcagccccagagctcagcagcccacccaatccagagaaggcaccgaggaaagatctctgctgaatgacaggatgcctggaatgctcaggcagcccaggctgtaagagggcaccatgctcgcccaggccataggaacccaggggggcccggcccaggtcctagtccgaggactccctggggcatgtggcagtggtgagtggactgaggaccccacagggccaggagtgctgggctcccttctccctggggatggtgccttgttggagggaagcctcccgacagggtctctgagggtagacaggagagtctgaggcagcaggagggaaggagtcagggtggggtgagaccctggagtcaccctttcagggcctgttgctccagctttgctgtacttgagcgttgttagactcaacagtcgctgt

SEQ ID NO: 57668 - DNA, 1122 bp, Homo sapiens
cctcggtttataaggcaccactgaatggcttcatggcatgcttgggaattacaaatgtcaaatcaaacaacatgaaattgtgcccttcttttgtgtgcgttcattagaaggacttggaaaaccaaatcatgatgtatcggtatttgttttttatacagaaacaatattgaaaaaaaggcccctcgatgaattcgtaaattaaggcaaggagatgcttacttgaaatgttgaaagcccccacagatctaatactccaaaccaaaaattatatgcagcactgatagcagatgttttcgtcctatctaaatatgaaaaagtattatatgttatgttgacatttaggctaaatctttcccttataaggtgtttgacataaatagcttttgttatgtaactcttcaatagaaggcatacacacacatttcttaaaggtcccagctgctattgttatcactggaggcataaaattggaatcctaacttccaatatcaaatttgagcacaaaccctataaaatgtatcttgtcagaatgtgccagaaccgctaagctcttttcggcggaacaaattgcagctggtgtccttaaaggtcgagaatcaaacttgctgtatcctcagggtttaggcagcaaattggtcccagttttcaccctgccgcagggctggctggggagggcagcggtttagattagccgtggcctaggccgtttgacggggtgacacgagcctgcagggccgagtccaaggcccggagataggaccaaccgtcaggaatgcgaggaatgtttttcttcggactctatcgaggcacacagacagaccatggggattctgtctacagtgacagccttaacatttgccagagccctggacggctgcagaaatggcattgcccaccctgcaagtgagaagcacagactcgagaaatgtagggaactcgagagcagccactcggccccaggatcaacccagcaccgaagaaaaacaaccagaagaaattattcttcagcctgaaatgaagccgggatcaaatggttgctgatcagagcccatatttaaattggaaaagtcaaattgagcattattaaataaagcttgtttaatatgtctcaaacagaaaaag

SEQ ID NO: 57669 - DNA, 340 bp, Homo sapiens
atattactattagtttttgcaaataactggtgaaaaaagaaaataaacaaaggggaatgtcccaaaacctagattcctgtactactctggctaaatgttttcaagaaagataagttggtcaagtgtctaaaaggtacatataacttctgcccacttaatagtattataaattattgaactttgttgtgacagtttaggttcttcataaactttgataactgtgttagttataactgatggagtcaactgatggtgaaaacgaagagcctcccaactgtacacgattgttttatttcccccaaggagtccaaaaggcagatgcagatagcgggcaagtgct

SEQ ID NO: 57670 - DNA, 554 bp, Homo sapiens
caattactggcatggtaatacctgtaaatcgtggctttgatggatcacggggtagtagagtaaccctttctgattgccctgagtcttttgatgtcccaagctttcagcctatttattgtcaagataccgaaaactagatcccacctggaaaagggagacacccctggctttgagaaagcacctcgttcactccaaacccatgccacattgcctcatgagatgacctcaaagccacgtacagttcccaccaggactggctgagatactgaagcaggatggtcaggcttacctagagagaagctcaagtgaagatagaaaatccatcacaatacaatgtccagaataagcaaatccatagagatggaaggtagatttgtgtcatcagggactggggaatgggaaaaatggagagtgactgctaatgggtatgggatttctttctagggtgatggttacacaactctgaatacaccagaaaccactaacttctccactttatttatttatttctttatttgaggcagggtctcgctcagtcgcccaggctggagtgc

SEQ ID NO: 57671 - DNA, 472 bp, Homo sapiens
agtgctgatggtggctccggccagcacattccaagcatccttgggtagcctgataaatggagtgcagaatgttcggtagctctgcaaggagtgggagtatttattgggtctgagtgcttgatgcgaaactttcctccaaagttccaattttctatccgccaagataagtgatggaggtttatggttcatgttgtagcacatccacccaggccaaggacctacaactctgaatttctggcctgcctccttccagctagaagtgaatctagatttacatgccatcaggaacaagcatcgtcttcctgttctgtgagttcctagttgtagtaggtactgctttcatcctgagaatatcaatctacatgcacaaggtccctctctgtggaggagtaggtacttaaacccaagataagtggaaactttatatccaaggagacagaaaataaaatttcagtatgttttatattaaaca

SEQ ID NO: 57672 - DNA, 543 bp, Homo sapiens
agtgctgatggtggctccggccagcacattccaagcatccttgggtagcctgataaatggagtgcagaatgttcggtagctctgcaaggagtgggagtatttattgggtctgagtgcttgatgcgaaactttcctccaaagttccaattttctatccgccaagataagtgatggaggtttatggttcatgttgtagcacatccacccaggccaaggacctacaactctgaatttctggcctgcctccttccagctagaagtgaatctagatttacatgccatcaggaacaagcatcgtcttcctgttctgtgagttcctagttgtagtaggtactgctttcatcctgagaatatcaatctacatgcacaaggtccctctctgtggaggagtaggtacttaaacccaagataagtggaaactttatatccaaggagacagaaaataaaatttcagtatgttttatattaaacaacttattatacttctatccttttatgaacataaggtcatcagtaggccaaaagtctgaaaacagtctcagt

SEQ ID NO: 57673 - DNA, 406 bp, Homo sapiens
ctcttcctgtctcacaggattaccatgataatcaaatgaaataacataattcctagtaaccatctgtcaccacttcatctacaccacagctttcccagtaaaatgggatatttaggccaccaagaaagcgtgatcaatgaaaattgcagaggaagtaagatgctaacttgctctacctgccactaccctgaacctttttttttttcaacccccttaacctctttaaagagcttctggcatgctcatgggtttttctttctagaactttccctgccctgaatttgttcagtatgcattgtcacttgtgaggacttcttttcacaataaatacccaagtgctttagaatgtctggatggtgggccaggcacagtggctcaagcttgtaatcccagcaatttgggaagc

SEQ ID NO: 57674 - DNA, 1143 bp, Homo sapiens
aacagaacttaaaaaaaaaaacaaactgtaattactaggaaattgactctaccagggaaattaacagacttgtccaaaattgtccctgtagacagagagggctggtaaggctggaatgaacccgtcgtaatttgaatgcttaaaactttttccattttattgtcaaaattattgcctgaacttcctttttctcctcatttgcctatttcccttgctttttatcttgtgcaccaccagtatacaacatagtggtgtttaactacttcctgaaggcattattagtcatcaggaacaccaggtcattatcgaagtagataaatgggcattccgcccatcgactaccccttggactaatttggaaaatatggttccttccctcagaagaaacagcccatgctcctctggacacttataaaatagccatgcgcacgtctctgttccttctgaacaactggaattaatgtgtcctgcttgatgctaaactggagtttaattcacaatggcaaggacgcttcacctagaatatctgtccatgtgaaaggtggggagcagtgcagcttccatctccctgtctgttttttggtgggctttcagcttttctgtcccatgactgttagtgactgcagcgtaaccccaaatctttcaccagatgttgtctcaccatcttaaggaaagaagaaagttctaatggatgttttgaatgtgctcgacttttattttgttcagacccaaactgaatgaggcagaggttaaaatcttttcttgttccatctgagtaagcacgaaaacctatgatccttaatcttttagaagaaaaataacccttctctgttagtgggatttctgattcatttcttctgccctgctcccctgctctgcatttttttagtcaaatactgtctggacttttgtgagccaataacctccctcctcaccttattcccctctcttcccctcccctgtgatcacacaaagagcagagagccctcaaaagcctgggtttctgggttttgtattttaaagagaggatgaaatacttgctgtacttcaaaacataaaaccgatctgttaaaactttcccaaaagaaactgattggcatcagcatagggggaataagaaaagtaagagaaattgagattaaa

SEQ ID NO: 57675 - DNA, 882 bp, Homo sapiens
ggtaaaataagttgtattgtgtttcataaaatcatgactaaaattaaggcaagtctatagatcactatagaacattaactaaatttttgaaacatttcagtgtactgcccacaactcttattttgaaaagtttttgaaatccttaattcacagccatacttaatagttgatttctgtttgtgtagtagtcatccctatggtctttcagaacttggcagttaatcctcctgggttttgactagttcagtgttttaacccctaagttagctttgggagctaggacacaagttcacaagtgtggacaggaacattaaactttctgccagccgaaatctgtcaggagcttggttcagattttttttaactctaaaaagcgctttggttcaaagcagattcgttaagagtgtggggagtttttgttttgttttattttaagctgcattaaactccaatgtatatgaaaggggcatttttataattgtaagttataatgtaaaacttttcctaatgtaaagttagtcaagggtacaatgaggtgttttaaccagaaaatcgtaatcagaatattctagattgccattgtagtcgttcagtgtttcaacatctgaataaattctgtgtcattgtttagctgtcacagtgtgaaaaacgttttgattcacaaagacaagtacttaaaaagaggtaacagtttttgacagcttaccttgcacactctgaataatgttcatttaaattgatacagcctgtagttccagctacctgggaggctgaggcaggagaattgcctgaacccaagaggcagaggttgcggtgacccaagattgagccactgcactccatcctgggcaacagagtgagaccctgtctccaaaaaaaaaa

SEQ ID NO: 57676 - DNA, 502 bp, Homo sapiens
caggtcttgggcagaaaaaatccaaactgctgtgaacttctccacctggtggaaggcacagatgccctagacacagatgcaactccggtctgctgtcttttacagaaggctttattctgcacatgaggacagcaggtacacatgtaagacttcatgcagtttgcctagaaaatacctccgaaatgcatgggctgcacacatagctatgtacccactccctcctgtgacaaggatctctcaagtcagatgaaattgctggccgctgtttgcacatactctttctcatgtaatgctcctttaatacccagaataagttcaaaagtgcccagtgtctgcttttcttgcttggggctttctttgccagcctcacagtagactgaggaattctaaacatgtgtctgcgacctggtgaggccgctgctgtgtgaggccatatgttttattggggtctatatcctgagagagataccagaaagaaactctgagatgtctgccaagtaaa

SEQ ID NO: 57677 - DNA, 362 bp, Homo sapiens
cacgcccctccctgctcattcagttgaggcctctcctcaagaagatatctttgcatttgttgtttttgtgttgctttgttttgtgttgccgtaaagatgtgagatgctgctcctgggactccaggctgattcctgacaccagcatgtctgcatttttgcagaagaccagagaattctggggttcgaagctatgaggttttggggtttctctaaggcagtggtgggaggaagacctctcccctgagccctctctcctcagccaaccaggaagctcagaattccacagcctccctgactcccacctcagcaggcaccaagattgctgtaattcggcactggcaggtcttgcaggagttcaactg

SEQ ID NO: 57678 - DNA, 298 bp, Homo sapiens
ccagcttctgcatatcagggtggtgatgcttgggctgagacaggtctagacagcactgtctgaaagggggctcaaggaagtagctgtgaaaggcccctgggatgttttctgctcccctttctgcaaattccctggagggagatcctgttagtcactacagggtgtgtgtgtgggtgtgtgtgtgtgtgtgtgtgtgtgtgtgtgtgttcatcacttgttgcttgggggtgggaagagacaacaaaagcctacagaatctatagttctcagttcatctcccatcctagtccaatcatgg

SEQ ID NO: 57679 - DNA, 4321 bp, Homo sapiens
  misc_feature (5)..(6): n is a, c, g, or t
  misc_feature (647)..(647): n is a, c, g, or t
  misc_feature (1046)..(1046): n is a, c, g, or t
  misc_feature (1400)..(1400): n is a, c, g, or t
  misc_feature (2014)..(2014): n is a, c, g, or t
  misc_feature (2378)..(2378): n is a, c, g, or t
accgnngagagcagccttggcgctacggaggagcctagggctaaccctcagccatacctggggctggtcctggagttgctacgcagggttgtggcagcactgactgaaggtatgagacccgattctcatccttatggttttccatgggaattggtgatacgtgcagctgttgctggattttttgctgttctcttcttgtggagaagttttagatcagttacgagtcggctttatgtgagaagagagaaaaagtttgctgtggcactttctggactaattgaagaaaaatgtaaactacttgaaaaatttagccttgttcaaaaagagtatgaaggctatgaagtagagtcatctttaaagaatgccagctttgagaaggaggcaacagaagcacaaagtttggaggcaacctgcgaaaagctgaacaggttcaattctgaacttgtgcatgaaatactctgtctagaaaaagagttaaaagaagagaaatctaaacattctgaacaaaatgaattgatggcggatatttccaaaaggatacagtcgctagaagatgagtcaaaatccctcaaatcacaagtagctgaagccaaaatgaccttcaagagatttcaagcgaatgaagaacggttggagatagaaatacnagatgcttggaaagaaaattctgaacttcaggaaagccagaaacagcttttgcaagaagctgaagtatggaaagaacaagtgagtgaacttattaaacagaaaagaacatttgaagactccaaagtacatgcagaacaagttctaaatgataaagaaaatcacatcaagactctgactgaacgcttgctaaagatgaaagatggggttgctatgcttgaagaagatgtaacggatgatgataacttggaattagaaatgaacagtgaatcggaagatggtgcttacttagataatcctccaaaaggagctttgaagaaactgattcatgctgctaagttaaatgcttccttaaaaaccttagaaggagaaagaaaccaaatttatattcaattatctgnagttgataaaacaaaggaagagcttacagagcatattaaaaatcttcagactgaacaagcatctttgcagtcagaaaacacacattttgaaagtgagaatcagaagcttcagcagaaacttaaagtaatgactgaattatatcaagaaaatgaaatgaaactctacaggaaattaatagtagaggaaaaatgccggttagagaaagaagagaaactttctaaagtagacgaaatgatcagccatgccactgaagagctggagacctaccgaaagcgagccaaagatcttaaagaatttgagaaaactattcatttttatcaaaagaagattattctccatgagaaaaaagcacntgataattggtcggcagcttggactgctgaaagaaacctcaatgatttaaggaaagaaaatgctcacaacagacaaaaattaactgaaatagagtttaaaataaaacttttagaaaaagatccttatggacttgatgttccaaatacagcatttggcagacagcattccccatatggtccctcaccattgggttggccttcatctgaaacgagagcttctctctatcctccaactttgttggaaggtcctctcagactctcacctttgcttccacggggaggaggaagaggctccagaggcccagggaatcctccggaccatcagattaccaaagaaagaggagaatcaagctgtgataggttaactgatcctcacagggctccttctgacgctgggcccctggcacctccgtgggaacaggactataggatgatgtttcctccaccaggacaatcatatcctgattcagctctccctccacaaaggcaagacagattttattctaattgtgctagactctctggaccagcagaactcagaagttttaatatgccttctttggataaaatggatgggtcaatgccttcagaaatggaatccagtagaaatgatnccaaagataatcttggtaatttaaaggtgcctgattcatctctccccgctgaaaatgaagcaactggccctggctttgttcctccacctcttgctccaatcagaggtttattgtttccggtagatacaaggggcccgttcataagaagaggacctcctttccccccacctcctccaggaaccgtgtttggagcttctccagattatttttctccaagggatgtcccaggtccaccacgtgctccatttgcaatgagaaatgtctatttaccgagaggttttcttccttaccgtcccccaagacctgcatttttcccccagcccccacattctgaaggtagaatgagtttccatcagggttgagnccgacttcaaatgagcctgctgctgaacatccagaacgacagcaagaaacctaacaacatgtttgccctcttcaaaagtaattttgactgatctcattttcagtttaagtaactgctgttacttaagtgattacacttttgttcagattgaaacttaatggaactataattcccaggatagtattttgtaaatgaggatgatttaaatatgaatcttatgagtaaattatttcattttattttattctagatagtataacttttaatttgattaatccactattatataaagaatggtgggagctttatatatgtaatcttgcaggtggggaggctttaaattgtctttatgtcaagaactgtatttactgtggttgtagacaaatgtgaaagtaactttatgcttaaataagttttagttgattaaaaaaatttaaaaaatttaaaaaaagaaatatataaatatgcacaggtgggaaggtagaatactatgtaactgttagaatatttcactttaaaccaagatgatcttggatctcctgtcttatagattttatatcctctttcagtactttgagagtgtaaaacatttatagcagaaagtattcgtgtttcctctgttttcctcaagaatggtttcttcgccctccctttccttcccttcgtcttccctaagctaatttcttcctatgtttgtcatcatatcattacataattgtgttgttatttcttttgttttatttttatttggtgggaacaactttatccagaacttttacttgccccagaattatatagatcagtttctcctgacttctttcccaacctttacctctgttggtgttctaatagttttagttttatgttctgcttttctcttgctgtggcaaggggaaggagtaaatctaagatagtgcttaattgcagttggtgaatttgatctctgattgagctctcttctctggaattctgttaaaagatgaaatgtatcgtgttccctgagagacgccctcaaattttggattagtccttcatgcaagctgggccaccaagccattgcttcttttggggacaacctgccctcacttttaaaaagcatcctagctcacatgcctcccctagcagttaatgccactccagtctctgcttgaatgtaataaaataaaagaaaagtaactatttgagacatgaggtgcccttattgtacactggggcttcctatacattttccgtcttcccttgaaccaccactatcctcagctactttatgcttctgttctgttaaagccctatttgctagtggaaaaatttaactcctggtgatttttttaatactaggcctcttgccttccttccagtgagagaaaaatagaatggtaagcctagtggtttcttccttcactgttgaatactatttatccaaggtatcaaggaagaacttctaatcagaaaagacatgtattattttcacaactgggtagcatatctcactcccagaatggaagttaggtgggaattgcaagattaaggagatttttctggatttctgtctatgtatcatatccacagaactctttctagaggaattttatattgagccaggcatccatttccacagtcttgcatttctagatacttccaaagttatagcactgttcctaaatcatttttggctttatttattaatttattgttcacttcatttcattaggttcagtatgaaacaggtattgtcatctctttgtgtctactttgccacctttccccagaataggcctgaatgagattgaaaacgttacttcagttccttgtgtctgacattgcttgtttgtaactaagaaaaataatatttgcttttgttgaatgactactaatttttttccatgaacctaataaactaaaaagaaagttgaaataataaagagtgaataagtataaaaatc

SEQ ID NO: 57680 - DNA, 3825 bp, Homo sapiens
  misc_feature (5)..(6): n is a, c, g, or t
  misc_feature (647)..(647): n is a, c, g, or t
  misc_feature (1046)..(1046): n is a, c, g, or t
  misc_feature (1400)..(1400): n is a, c, g, or t
  misc_feature (2014)..(2014): n is a, c, g, or t
  misc_feature (2378)..(2378): n is a, c, g, or t
accgnngagagcagccttggcgctacggaggagcctagggctaaccctcagccatacctggggctggtcctggagttgctacgcagggttgtggcagcactgactgaaggtatgagacccgattctcatccttatggttttccatgggaattggtgatacgtgcagctgttgctggattttttgctgttctcttcttgtggagaagttttagatcagttacgagtcggctttatgtgagaagagagaaaaagtttgctgtggcactttctggactaattgaagaaaaatgtaaactacttgaaaaatttagccttgttcaaaaagagtatgaaggctatgaagtagagtcatctttaaagaatgccagctttgagaaggaggcaacagaagcacaaagtttggaggcaacctgcgaaaagctgaacaggttcaattctgaacttgtgcatgaaatactctgtctagaaaaagagttaaaagaagagaaatctaaacattctgaacaaaatgaattgatggcggatatttccaaaaggatacagtcgctagaagatgagtcaaaatccctcaaatcacaagtagctgaagccaaaatgaccttcaagagatttcaagcgaatgaagaacggttggagatagaaatacnagatgcttggaaagaaaattctgaacttcaggaaagccagaaacagcttttgcaagaagctgaagtatggaaagaacaagtgagtgaacttattaaacagaaaagaacatttgaagactccaaagtacatgcagaacaagttctaaatgataaagaaaatcacatcaagactctgactgaacgcttgctaaagatgaaagatggggttgctatgcttgaagaagatgtaacggatgatgataacttggaattagaaatgaacagtgaatcggaagatggtgcttacttagataatcctccaaaaggagctttgaagaaactgattcatgctgctaagttaaatgcttccttaaaaaccttagaaggagaaagaaaccaaatttatattcaattatctgnagttgataaaacaaaggaagagcttacagagcatattaaaaatcttcagactgaacaagcatctttgcagtcagaaaacacacattttgaaagtgagaatcagaagcttcagcagaaacttaaagtaatgactgaattatatcaagaaaatgaaatgaaactctacaggaaattaatagtagaggaaaaatgccggttagagaaagaagagaaactttctaaagtagacgaaatgatcagccatgccactgaagagctggagacctaccgaaagcgagccaaagatcttaaagaatttgagaaaactattcatttttatcaaaagaagattattctccatgagaaaaaagcacntgataattggtcggcagcttggactgctgaaagaaacctcaatgatttaaggaaagaaaatgctcacaacagacaaaaattaactgaaatagagtttaaaataaaacttttagaaaaagatccttatggacttgatgttccaaatacagcatttggcagacagcattccccatatggtccctcaccattgggttggccttcatctgaaacgagagcttctctctatcctccaactttgttggaaggtcctctcagactctcacctttgcttccacggggaggaggaagaggctccagaggcccagggaatcctccggaccatcagattaccaaagaaagaggagaatcaagctgtgataggttaactgatcctcacagggctccttctgacgctgggcccctggcacctccgtgggaacaggactataggatgatgtttcctccaccaggacaatcatatcctgattcagctctccctccacaaaggcaagacagattttattctaattgtgctagactctctggaccagcagaactcagaagttttaatatgccttctttggataaaatggatgggtcaatgccttcagaaatggaatccagtagaaatgatnccaaagataatcttggtaatttaaaggtgcctgattcatctctccccgctgaaaatgaagcaactggccctggctttgttcctccacctcttgctccaatcagaggtttattgtttccggtagatacaaggggcccgttcataagaagaggacctcctttccccccacctcctccaggaaccgtgtttggagcttctccagattatttttctccaagggatgtcccaggtccaccacgtgctccatttgcaatgagaaatgtctatttaccgagaggttttcttccttaccgtcccccaagacctgcatttttcccccagcccccacattctgaaggtagaatgagtttccatcagggttgagnccgacttcaaatgagcctgctgctgaacatccagaacgacagcaagaaacctaacaacatgtttgccctcttcaaaagtaattttgactgatctcattttcagtttaagtaactgctgttacttaagtgattacacttttgttcagattgaaacttaatggaactataattcccaggatagtattttgtaaatgaggatgatttaaatatgaatcttatgagtaaattatttcattttattttattctagatagtataacttttaatttgattaatccactattatataaagaatggtgggagctttatatatgtaatcttgcaggtggggaggctttaaattgtctttatgtcaagaactgtatttactgtggttgtagacaaatgtgaaagtaactttatgcttaaataagttttagttgattaaaaaaatttaaaaaatttaaaaaaagaaatatataaatatgcacaggtgggaaggtagaatactatgtaactgttagaatatttcactttaaaccaagatgatcttggatctcctgtcttatagattttatatcctctttcagtactttgagagtgtaaaacatttatagcagaaagtattcgtgtttcctctgttttcctcaagaatggtttcttcgccctccctttccttcccttcgtcttccctaagctaatttcttcctatgtttgtcatcatatcattacataattgtgttgttatttcttttgttttatttttatttggtgggaacaactttatccagaacttttacttgccccagaattatatagatcagtttctcctgacttctttcccaacctttacctctgttggtgttctaatagttttagttttatgttctgcttttctcttgctgtggcaaggggaaggagtaaatctaagatagtgcttaattgcagttggtgaatttgatctctgattgagctctcttctctggaattctgttaaaagatgaaatgtatcgtgttccctgagagacgccctcaaattttggattagtccttcatgcaagctgggccaccaagccattgcttcttttggggacaacctgccctcacttttaaaaagcatcctagctcacatcatttccacagtcttgcatttctagatacttccaaagttatagcactgttcctaaatcatttttggctttatttattaatttattgttcacttcatttcattaggttcagtatgaaacaggtattgtcatctctttgtgtctactttgccacctttccccagaataggcctgaatgagattgaaaacgttacttcagttccttgtgtctgacattgcttgtttgtaactaagaaaaataatatttgcttttgttgaatgactactaatttttttccatgaacctaataaactaaaaagaaagttgaaataataaagagtgaataagtataaaaatc

SEQ ID NO: 57681 - DNA, 399 bp, Homo sapiens
aaaacccagggctttgctgctaacatagatgcaaaagagcatgcctcttgcgctcttggtgcttgtgctccaccatgacagcttagacaccaccagtgcggagatgtaagatgcacacacagaggccaggatctggttcctaatcctaactcatcctgtccgctgtgtgaccagagcaagtcctggcactactctgaacctcagtttctttatttgtaaaaatggggtaataggctgggcatggtggctcacacctgtaatcccagcagtttgggaggtggaggtgggcagatcacctgaggtcaggagttcaagaccagcctggctaacatgtcaaaaccctgtctctactaaaaatacaaaaatagccaggtgtggtggcatatatatatatatata

SEQ ID NO: 57682 - DNA, 492 bp, Homo sapiens
caaaacctttatatgaatctgtatagcagctttatttataatctcaaatgtctggaaacaaacattcttccattggtgaatgaataaacaaatcgtggaacatctttcaatgaaatattactcagcaataaaaaaggaatggagtatcgataggcacaacaaggaagaatttaaaatgcattgtgctaagagaaataagccagcctccaaggggtacatacaaattataaaattacattcatagaccttctaaaaatggcaaaactgtaggtctggagaacatcattggttgctagggaatggtgttggggaaaagaattgaccacaaagatatagcatgaggaaatttttgggagtgatgtatctgttttgtttcttagttgtggtgtgattacataactgtatgcatttatcaaaactcatataactgtacaccaaaagagtagattttactgtttataaattgaaaataaagtttttaaaagaaatata

SEQ ID NO: 57683 - DNA, 395 bp, Homo sapiens
agacgacaaagatgttaaatttattcctagaaaatgtaatgtaaataatccaattaaacatcagaggttgtcaaattggttaaaaatcaagtcccaactgtatgttgcttacatgaaactacaccttaactataaggacacagggaggttaaagcaaaagattgggaaatatatgccattctaacatgaatcaaatgaaagctggaagagctatttaatatgaaagtatatttcagagcagaaaatattacttgggataaagaggtcatttcataataattaaagagttggtttatcaaaagtaaataacaaccttaatatcttatatacctaataagaaaacttcaaattacatgaaccaaaagctaatataattgcaaggaaaaataatcaaa

SEQ ID NO: 57684 - DNA, 464 bp, Homo sapiens
acctatgcacctgctccactgtgtctgcttctcatagagacactcttcctgctgagtctctgacctctgctcctagatccaaatggcatctcctgccctatccctgtatggcttaacctagggaaactctttcccagaggagtcaggtaaaaagacagtggctgagcttcttacagatttaaaggagacatcctggaatttaggactccatccttcctttctgtcccctggcagctcctgctgcttctcaaagtttagctttgtctctcatccagctcagactgttgctggtcctgatggcctctgcttagctgtattagtatgttcttgcattgctataaagaaatacatgagaaatacctttagttggctcatggttccatagggtatacaggaagcatggtggtttctgcttgtggggaggcctcaggaaacttttactcaaggtgcagggcaaaaaaaaa

SEQ ID NO: 57685 - DNA, 1429 bp, Homo sapiens
ctgggaaatggggaagaggtagggtgcctgtagacacagcccctttcaggatctccatgcccagggttctggcacagagacacctcctttttggagagaaaggtcagagtaggctgtaggccttctctgcgtctgccctgtgacctcaaagaacttcctctagcaggaaattagctgctggagccctcacccccaaccagccccaggcggaagcagcacagggggctcctcccccacacacagaggtcactccatgccaccgccgtcagggcgccaaggtcctcatgttctcagaagacccactgccctgcattccatcatcccagggcggccggctgggggtggccaggacctcaacaggcctcctttgtcctggctctgccgtcacccggcacaactggaaccagagcagccttgtctggggccctgggctcggggcccgttcatctgtgagagtggagccaggactcagctcccagccaccagcgagtcctgccggcctctgccctggactcctcctgcgctcaccctcaggaactcagggctcaaagtcggccgggttgaagggcgctttcctcggacaggcaaagcccgggggcgccccgacagagcagctccttgcaggggtgccagtcacaggaccggacggcgccctccctcagtgtcctgggtgccatcttcgggcccaggccccacaccaccccctccctccagcaggagcaaagacgtgggaaaaccagcccagagctgggtccgaggcggccccacccagcctaacacgggacagctgccgaaagaggggctgaggacgccccacccagtccctagagctggaatcccttcctccagacaggcccttctaagctcagggaacccggggactcgggcacccagcgccccagcactccgccccgaggcccaggcaagtccaggggagtttccaggcgcaccattcctgagctaggtggggagaggctgggtggcgcccgtttccaggaacccccaccccagccggcagcgagcttcccgggagcagccgctacccagggagaaccgcaacctggccccagagcccagagcggctgcaactctggggccaccgaacccgtccagccggcctccctgtcccccgccccttcccatcccggccacaccccctcccctcccctccccgtgccccggcgctcggctgggggacctgggtgggggctgcggattttgctccccgcactgtcctccccgcccctgccgctcccagctctgtccgagccggagggtcaagccctgggagctccaggagcacccggggagggaactcggctgccaaatggccccagaggccgaaaggaattcaggggggattgccgctgtccccgcataggagaagcagctggggctggcgggacccgggaccgggatcgcggccgct

SEQ ID NO: 57686 - DNA, 582 bp, Homo sapiens
ggctttttaaatgaccccaggcctgtctataagcaaaaaactctactccatagcctctctatcctttcatcacctcttgggagagggatagataaatatgacatcataacaaaacacgtgtaatgtaaatgtattacaaagattgtgtaaatgaagcatttatgaatattctattaactattcgatttcccactgtagctagcacttataaagaatttgataagtaactagataaatgaatcagaaaataaatctattgttcaaatttcatcagaatgaattaatgagtgataagttctccttgaagaaagactgaggataaatcagcttaaacatgaataaaattttaacaggtaaagaaggcattccaagagaaggaacaacgtgaaaagaaacaaactcatgaaggcctgaggcatgagcatgtgttgagcatttgggaaagaacaaagtcatgttataagaccctataatgcttggcaaaagatagtggcaagaaagctggggaaaaaaagctgggatgacatgataaagaattttatatttcagtcaaaataaatgtcatttcattggagcttaata

SEQ ID NO: 57687 - DNA, 424 bp, Homo sapiens
cttcaaaatggcgagaagataatgagaaaaggaaagaatctatggataagaagtaaggagaaaatcgttgacaattgtcaaaatcttgcctcattacttctccaggaatgatgtctatccttttcttcaaacacgttctgtattctaggaattctgaattattttggattagccaaactcactataaactctactgtaaagaaggcattccaagagaaggaacaacgtgaaaagaaacaaactcatgaaggcctgaggcatgagcatgtgttgagcatttgggaaagaacaaagtcatgttataagaccctataatgcttggcaaaagatagtggcaagaaagctggggaaaaaaagctgggatgacatgataaagaattttatatttcagtcaaaataaatgtcatttcattggagcttaata

SEQ ID NO: 57688 - DNA, 327 bp, Homo sapiens
aatgagattatgtacatgagacacttagcatggtgcccctgcagcacatacagtattcttgtccttaacgaaagtttattattttaattgattatctgttacccttgacaacaaaggaaagtagtgataaatgccatatttagccttgagtttcaacatttttctcctgtagattggtttgtgtttctcacccttcttgtccccccttcactctttcttttctagcaccttctgcagcatttcttgttttacctttgggtgtcattagacgttgtttacatcattgtctggcggaccagtgctgtttgcaaaaagctcaggtgcttc

SEQ ID NO: 57689 - DNA, 567 bp, Homo sapiens
ggcacgctcatctgtttttctcccaggatacgcgggtctgtgtatgagcagctgctctgagcttgcgactgggagggcagagggtgtagactcccgcgtcccggggctcccttcctcgctcttccttcggacacccacagcagctgctcctggggaatctgcccccaagtttcgaggaactgccccccagcgcccaggaggaaaggggaatggggctgtaaacgtgtctaattcagacccgttatccagatcggaattagtttctcgcggacacctccgcgccgcgggccattctctgcctggggcctttcttggaccgatccatagggcctcgactggcttccacggcgcttgcaaattagagactctgatgcctcaaatttgtggggtcctgcctccagctcatccccctctcccgaggcttggcctaaaggcaccatccctgccactcctcaccccctgaattcagtcgggggcctgtgtggagggaaaggaaaacctggagagaccaagtggctgcactgccaccgcgcaggcatggatcctgcctggccgccgtctgggaac

SEQ ID NO: 57690 - DNA, 304 bp, Homo sapiens
tgattgcatcaagcctggaaattggcagaattttcacattgaccccttgtggagtgaggactatttaggaagactaagtggaagcccctgaaactgcccttcactaacaaaagacaaaactttaagcagtgctacatccctacaaacattgcacagagcagggctaccttcaaagacttcaatctcagtggagaatataacatctctttttgatttgctgattggatgaatggatcttggagatcaaatatggagtaacataatcctaatcagagagtgactcttagttgctttgctttccaaa

SEQ ID NO: 57691 - DNA, 585 bp, Homo sapiens
tacatgtgcttaaaagcattattgtagcttcatttgcctctgaatttcccgagtggttgtaacaaggttgtcttcctgaatctctgcaaatttaagtcagcttgcactaggaagccacagatgtccttagagttgagtttaatcttgactcaaatcagcttctcctccagagctttgacatatgacttagcaagagcttttccttcttctttctgccttcacttcccagttcccaaaagaccagttttcaggacagtgtgatcctagagatatgggaagagagggaggaagcaggctttgatctttgccattgtgtacccatagaactcactcccagattctttttcctttttctttctctctccctttcttctgtctagctgacttcattgtcttcctgctcatattctgtctatgacccttataagacagcaaacaaacccacaatcaaggctcttgcttcattgaagccctgagaattggctacatgaggcctttgctcaagggacttaatatttaatgtgttcatgattgggttaataaaacagggagcaggtgacaaatttagtctatggaagccccatt

SEQ ID NO: 57692 - DNA, 328 bp, Homo sapiens
tgtagttgcaatagcattccaagtagtcacctgattttttttccttgctcacctggcatctgttcttcccttatcagccaaagtgaccctcttaaaaagatcatgccaatcctccatccagtactccccaaaggctttctatctcactcccagtaaaaatcaaagatgttgcaatagctcctacatcatctgttcctacataccagcctgatttcatctcctacagctttcccgcactctctcttctttgcttcagccacccttgtccccttgctgtagctggaacacgccaactgtgctcagcctcagggcctctgcacctgctagt

SEQ ID NO: 57693 - DNA, 540 bp, Homo sapiens
ctgtaagttgcatttcttaacagaacatccaaagtgtatccaataaatggcagtttaactcatttttaggagctgcataatattccagattgtgttagcaagtttattcaaccatttgctcgctgacaaacattgtttccaacttgtcgctcgcagtgctgcaataaacagccttgactaagttctgtgtgctggcagccttcaccttcctattcgttgaagcagttttaatctgggaagaaaattgaatgtagcttattctcagataggactgtggcctaatttaaaaagaggtcctggccgggtgcgggcggatcacgaggtcaggagatcctagaccatcctggctaacacagtgaaaccccgtctctactaaaaaaatacaaaaaaattagccgagcgtgttggtggacgcctatagtcccagctactcggcaggctgaggcaggagaatggcgtgaacccgggcggcggagcttgcagtgagccgagatggcaccactgcactccagcctgggtgacagagcaagactccgtttc

SEQ ID NO: 57694 - DNA, 114 bp, Homo sapiens
gtgaaaataaaataaaatgacatggtttatgttacaaataacaaaagaacatttttccaattgcatgtgtgacattatatgtggaaaaataattagatgctacatgtgctatac

SEQ ID NO: 57695 - DNA, 1459 bp, Homo sapiens
agacgctatgctccagggcctgatgaaattattcgagccagtcaaccctaagtctgcttaccctgcctcattcattccttcccatggaaaccacaataggctgtggtccacatttcccctcaccccttctgcctcctgaccacccctggtgcttctctgtgtgccccctgtgacacagtatgccccctcctcttgcgctctgtgagaataaactgtcttttcaatgcctgttgtctcttgctctggtggcctcaccagacccaaatgataataaaacatacattttaaaacaggcatcaaacccagactgcgtgtgttctgtgttcctactgggccaattcatttgtatgtacatggtgtaacaggccctaaactaaatgttaggggtacaaactagaaaaaggcacgttcttgccctcagtgcgctcacagactgtggagaatgatggacactgaaataaggatgatgtgtaatatattacttagagagttttgagcatgatgctggctgcaagaaggtaaaagagagaggaatttcttctgcttggtattgggtcatcgtgggagatgagtcagggaagtctacaaaaaggaggagatatgcccttgtccctcagattgtccccaaaaagctgaaggttctttggtatctgtgtccgttagggttcagatggagaaatgtgcttgtgtcacatctccaatgataagcatatgctctgtgtacagtaggtgcgtcctgcaggtttgttatgggtatgatgaaaggcataccatcctgtgaatgaataaactgtagacaagtccatagagatagaaacttcaaactagaatggcccttatagttttacagattagcagccaactgttgtcctactggttgaatttgggctatagatattttgtctggcttacaccttgttaaaatacagaattagtagtcgttgcttaataactgagctattacatatgaaaacgtatatgtctagtatccctggaaaaaatcagatgcaacattgggtttttggtggatgctaaataacagccactgccttatgatggggcaggaactcttccattttgttccagtcctcacctggccacttcgttgtgtcacctgtttggttcggttcttgaaggcacttccggtttgcaatccttagaacaagctccctacttttctgcctcccttttgtgttaaataacagatatgaatattgaaacctgggatgggaagtgacttgtacacagtggcaaggcgggtactcaagtcaagactcctgactcccagttccccacaaggagttagtcagcctagagaaaataacgtctccactgcctgaaacacagtgtaatttacatcacacttataaattcaagggaaaattatctgatcactgcagaacattgagacactagaaactgaaaattgaatttcgagctcagaaataagggaaatgag

SEQ ID NO: 57696 - DNA, 283 bp, Homo sapiens
tttgcctgtgattagtggtttggcttgggaaaccttggaaagggctcagagaaccaagctgctgattaacgccacagctggtcaacacagcggacagctgaccgccgaggtccctgtggtctgtggttcctgcctttcaggctggtgtgggactggggtgttggtttggatcctagagctgaggtgtagccttacagctctgggtctctcctggtgttccagtggaactagcaccccagagcagggccctcaggggacttggcggctaacttcttgctgggaa

SEQ ID NO: 57697 - DNA, 431 bp, Homo sapiens
gatgtcgtgggaatgacaggcatgacttccatggctaggtcataaagagattgtggcttctaccttgctctctcttggaccccagttgctggaggaagccatctgccatgtcaaacagcctatggagatgcccatgtggggaagaatggaggtcccctgccaacaatcagctttgacatgccaagcctgtgagggagccatctggaaagggagtcttccagccccaatcaggccttcagatgactgcagccctggccagctccttgactgcaacctcatgacagaccttgagcaagaactgctcagctaagctgcttctgaattcttaacctacagaaatgtctaatgctttaagaagcaaagtatggggtaatttaccacatgcaatagataacaaaaccatgtgcaataaatactggttaaacaagtga

SEQ ID NO: 57698 - DNA, 406 bp, Homo sapiens
agcctggccaacatcgggaaaccccatctctactgaaaatacaaaaatcagctgggcattgtggtgcacacctgtaatcacagctactcaggaggttgagacaggaggattgcttggacctgggaagtggaggttggagtgagccaagatcatgccactggactccagcctgggcaacagagcaagactccatctcaacaaccacaacaaaaaagagatattaaaggaagtccttcacctagatggaaatgatactagatggaaatatggatctgtccaaggaattaagagctctggaagtggtaactacctgaataaatatatattattcatgtatatatatgttataatatattgttcttattcttattattcagattattttagaagataattaatgtttaac

SEQ ID NO: 57699 - DNA, 534 bp, Homo sapiens
cttataggaaggctaggcttggtgggtacaagtaagaaagccaagcagagagaagtctggactttgccttctccacctccttggaagacaggctgctcatcccattgtggtgtctcggctggtgtatgttttctgcctaggcttaatggacagcacgaggaggtagggactgacgttacccatgttttacagtggaagaacctgaggcttaaagagatcctgagctttaaaatagctagccaaacgaaaacaccaatggagactctttggaagggactgtgctcagtctgaggacccagagccaagtcacagacatgacctcaaaagccagtactgtgctcttccacatggcatccactggccacgtgtggtgatttaacatgtgaaatgaagtctcaaggctgagatgtgatgcgagtgtataatacacactagatctcaaaaacttagtagaaataaaaaatgtaaaatatcataaaaagattttaaaactacataaaaagaaaaaaaatttcaaaagaaataaagacaaca

SEQ ID NO: 57700 - DNA, 369 bp, Homo sapiens
attccttaagaacagagccatgatttctgtggtctgatttgggtttttagctggaagctttctaagttttaaatacccatgtccatcaggaagtccttaaagaagaaataatttatcaaaaaataaaaaggtgtggagttagataggatggtaatttcagccctcccaacccactggctagaggctcagggatcatacaaggcagtgttaacttaaaaaaaaagtcatacaatgtgtacatttggaaaggagactttatttcttacaaagggttccatcctgcaaggtggccatcccgcaggctgggaagtatagccaggcactttgagggggtaccgagcctcaattccttatccttgtcattgctat

SEQ ID NO: 57701 - DNA, 568 bp, Homo sapiens
attccttaagaacagagccatgatttctgtggtctgatttgggtttttagctggaagctttctaagttttaaatacccatgtccatcaggaagtccttaaagaagaaataatttatcaaaaaataaaaaggtgtggagttagataggatggtaatttcagccctcccaacccactggctagaggctcagggatcatacaaggcagtgttaacttaaaaaaaaagtcatacaatgtgtacatttggaaaggagactttatttcttacaaagggttccatcctgcaaggtggccatcccgcaggctgggaagtatagccaggcactttgagggaaggagaggtaagacaagaatttaagttgaatgggttgatcaaacatacatatttaacaggttataggaggagctgtgactgttcacaaaggaggtcctcacacatggataatgaactaatgtgcgtgtaacacatgacccatgttcaccttggggtggagacttatcctttaagtgtattacagttaggccctatgcgtcaaaagatcttttcgggacacagaagcactgaagtgg

SEQ ID NO: 57702 - DNA, 495 bp, Homo sapiens
tttattgacatatcactttttattttcagactcctaattcatattcattattaaatagttgtgtgattcatagcagaagcatttaattaaattttagtgaaatggtctttcttagagccaggaaaattctttattccagaaatcaaaagacgatttcctcaaacatcagaatgaatcactaagtaactttgaaccaagataaaatagtctaccattatgaatccttttgaaatacaggtgttccctctccccattttaacaaggcttatttaattaaaacttttggaaaattagtaaactgatagactataaattaataagctacaaataaatagctccaaatataaacaggtgtttgaaaattatatacagtcagtgtagtttcttgatataaatgctaacactgctttgattatataagatcataaaagctagagaaagacacgcttattaaggaaacaaataattctcctttatattattctctacattagc

SEQ ID NO: 57703 - DNA, 284 bp, Homo sapiens
tcggctcaccaagtggtggggaaataagatcgcagtcaaacatttgccatgtgtacattacagtgtgtaaaccatggtagtaatgcttagagtcataggctctttcttttgaaattgcacttatctgaaatgtaacaaaaatctttaggagaggaaaagacaaaccaaccactctgaacagtcagaatagaagttacacattccatttgctgaaactcatccattgtctctcatgagaacttccctctcaaagcctaatcacttctacttgacaccctggaata

SEQ ID NO: 57704 - DNA, 267 bp, Homo sapiens
ttgctcttcaactttcttttgaggctttaaattaggcaaatatatttttcttagaatttctgaaaactccttttcactggagcttattttaattatatggatgcattatcctcttaaacttctgtgaaaacaataattggagttttcatttgcattggctgtttcatgagaggtcaagctttttgcttatttattttgatgtttccttttcatgatatctgtgtcttgggatttggttgtatattcacatttttaattagctacttg

SEQ ID NO: 57705 - DNA, 1923 bp, Homo sapiens
ccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgtta

SEQ ID NO: 57706 - DNA, 1162 bp, Homo sapiens
ccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcgcaaaagaaaaaaaaaaaaaaaaaaaaaaaaaaaaaaaaaaaaaaagaaaaaaaaaaaaaaaaaaaaaggggggggggggaaataccaccagggggcgggcaacaagtggcagcaacccagtctctgtgcgaaaaaggacgacccaactaggaggagacgaataaataacagcacagcgcgagcggcgcaataacaacacggcgcggggggaacacaagcacacgatgcgacgtgtggagaagaaacccactagggggggggggaaacgggaacaaccaaccagaaagaaaggcgcagggaaacaaatgcaggtgtactgagtgcaacagcgatgtgcgggccagaatagcgagtatagaat

SEQ ID NO: 57707 - DNA, 1869 bp, Homo sapiens
ccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgtta

SEQ ID NO: 57708 - DNA, 2644 bp, Homo sapiens
  misc_feature (2363)..(2363): n is a, c, g, or t
  misc_feature (2412)..(2413): n is a, c, g, or t
  misc_feature (2422)..(2422): n is a, c, g, or t
  misc_feature (2447)..(2447): n is a, c, g, or t
  misc_feature (2450)..(2450): n is a, c, g, or t
  misc_feature (2457)..(2457): n is a, c, g, or t
  misc_feature (2501)..(2501): n is a, c, g, or t
  misc_feature (2506)..(2506): n is a, c, g, or t
  misc_feature (2509)..(2509): n is a, c, g, or t
  misc_feature (2514)..(2514): n is a, c, g, or t
  misc_feature (2516)..(2516): n is a, c, g, or t
ccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgttaatgggatgttttaaataatgaatttttcatccagcatcagttgaaaaggaaaagaaagcttcattatggaaatgacaatattgaatatgacagataagtttatttgcttctgttttaactgcagttaatagtactagacaactttaagtggaaagcatttagtttatttcttcacttatttgtagagtgaacaaatgattcacaattctacaagtaattccacttaggtaacttacagttgttaggtttgacaataaagatctactatgagaggagaagaatttatgggttttgggtggaaggaatttctcaaagaaataaaaaatgttctttgcccttgatactgcaaacccactgatacaagtgccttgaatttattattattattattttttatttttttgagatggagtttcactcttgtctcccaggcgagatcntgccgctgcactccagcctggcaacagagcaagactccatctcaaaaannaacaaaaanaagtagagatgggatctctagcctnctnaagttantttagcctcccaaatgcaagacaagaatctaacataaaatttancttgnatnagaantntgcatcatcgaatcttgcgctgctatgaattatcctggagtagggatctgcatctggggcacctgtagactggtgcgagtttaaacctaaggatatgcattgactcacgcaccattagtctcatacat

SEQ ID NO: 57709 - DNA, 2761 bp, Homo sapiens
  misc_feature (2480)..(2480): n is a, c, g, or t
  misc_feature (2529)..(2530): n is a, c, g, or t
  misc_feature (2539)..(2539): n is a, c, g, or t
  misc_feature (2564)..(2564): n is a, c, g, or t
  misc_feature (2567)..(2567): n is a, c, g, or t
  misc_feature (2574)..(2574): n is a, c, g, or t
  misc_feature (2618)..(2618): n is a, c, g, or t
  misc_feature (2623)..(2623): n is a, c, g, or t
  misc_feature (2626)..(2626): n is a, c, g, or t
  misc_feature (2631)..(2631): n is a, c, g, or t
  misc_feature (2633)..(2633): n is a, c, g, or t
ccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgttaatgggatgttttaaataatgaatttttcatccagcatcagttgaaaaggaaaagaaagcttcattatggaaatgacaatattgaatatgacagataagtttatttgcttctgttttaactgcagttaatagtactagacaactttaagtggaaagcatttagtttatttcttcacttatttgtagagtgaacaaatgattcacaattctacaagtaattccacttaggtaacttacagttgttaggtttgacaataaagatctactatgagaggagaagaatttatgggttttgggtggaaggaatttctcaaagaaataaaaaatgttctttgcccttgatactgcaaacccactgatacaagtgccttgaatttattattattattattttttatttttttgagatggagtttcactcttgtctcccaggctggagtgcaatggcgcgatcttggctcactgcaacctccgctcgctgcaacctccgcctcccaggttcaagtgattctcctgcctcagcaagcgggaggcggagcttgcggtgagccgagatcntgccgctgcactccagcctggcaacagagcaagactccatctcaaaaannaacaaaaanaagtagagatgggatctctagcctnctnaagttantttagcctcccaaatgcaagacaagaatctaacataaaatttancttgnatnagaantntgcatcatcgaatcttgcgctgctatgaattatcctggagtagggatctgcatctggggcacctgtagactggtgcgagtttaaacctaaggatatgcattgactcacgcaccattagtctcatacat

SEQ ID NO: 57710 - DNA, 2427 bp, Homo sapiens
ccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgttaatgggatgttttaaataatgaatttttcatccagcatcagttgaaaaggaaaagaaagcttcattatggaaagagttttttcccagattaatgacagaattaatggaactacaggaattctatgacccagatacagtggaacttatgacctggataaaaaggcaagctccagttgcagctgtgtttgcagggagtccacagttaatgggtgcgatagtgtcgggaataccaatgggtcaccctgcatcaaaacacatggagcagactgctgagccagctcaggggaagcggagagaccccaggagtgacggtgagaatgcaactcacttgtcattacacaggatatggcagatcggatttgaccaacaaaatggggaggaactgatccagatgtggaatgtgacagagaatcccttcccactgccatggaacatttataaaaataatcatacgttaatcaatgaagaaagggagccacacattaaaaaagcagaaatgacaggc

SEQ ID NO: 57711 - DNA, 1784 bp, Homo sapiens
ccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtcaagaagcatcctgagttgacttcccgtcagatcccactggttgggactgagtcatctgttgtatcctagttataaaggagactagaaaagtgcataactggctttttgagcctctagagtggcaggcgaactctgatgttgaggaaaaaggatagggtaatggtgttgacacaggcactgttgaatacgtatgtacatattttaatagttttctcattaatcaaatggaaatgctatcgattttataggatcgttgtgagaggaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcaggatgcttcttgacgcatcctgagttttatacgtataatttaccagtttccagtacactacaaaatatggattggaatatgggccgcttagctcagaggaggaatgtaagaagcctaaatgacaagaa

SEQ ID NO: 57712 - DNA, 506 bp, Homo sapiens
gcggccgcctactactactaaatttgcggccggtacgactgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgtta

SEQ ID NO: 57713 - DNA, 2540 bp, Homo sapiens
gaacttgtttgagccgtaagcccgagcctagcgtcgcacgctgggcgactcccctcaggctctcaggccggcgccttcgggggaccacgtagcgccccagcggtggcggctgcgcccggctcagggcggtgccgcggccactggctcctcctcggggtggggcgggccgcgccgggcgagggcgggaggaggagcagcgcagcggcgtgaggagctgccgcgcgaggagcgcgtcgcgtccgcacttctcctgcccgagagactgagccgcgctggcagctcgcgtcgagtcggactgccctagccgcatcccgcggcgcccggtcgggtcccgggcaccaggcaacacctaggccgttcccttcagacagccccgggccagcggccccctcgggaaatgtccagcggccgcagaaggggcagcgccccctggcacagcttctcccggttcttcgctccccgaagtccttcccgggacaaggaagaggaagaggaggagaggccggggacgagcccgcctccagctccaggccggtccgctgccagccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttaaaaaa

SEQ ID NO: 57714 - DNA, 3660 bp, Homo sapiens
ttttttttttttcctccccagcattgctgccactgtgctaatggaagcagccacggcagctttgtttgatagagatttttggctgccgtttttaaatactacccaagaagcagctcgtatttcatcaatgttgcgttgacaattggaaaagaaaagtgtaattgcgtacaggcgaaatggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttaaaaaa

SEQ ID NO: 57715 - DNA, 2412 bp, Homo sapiens
cactctttgggaggccgacgcgggcggaccggcgggtgctgggaaccgagcctcggcttgcggccggcagtttccgtgggtctgtgaagaggtcggcggcccctgcgggcgccagtcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttaaaaaa

SEQ ID NO: 57716 - DNA, 3708 bp, Homo sapiens
aaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttaaaaaa

SEQ ID NO: 57717 - DNA, 3708 bp, Homo sapiens
ttttttttttttcctccccagcattgctgccactgtgctaatggaagcagccacggcagctttgtttgatagagatttttggctgccgtttttaaatactacccaagaagcagctcgtatttcatcaatgttgcgttgacaattggaaaagaaaagtgtaattgcgtacaggcgaaatggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagtgggagttggatactctttctttcaagcatgtaaacttttttcaaaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttaaaaaa

SEQ ID NO: 57718 - DNA, 560 bp, Homo sapiens
  misc_feature (281)..(282): n is a, c, g, or t
  misc_feature (537)..(537): n is a, c, g, or t
gtactgtgtgtttgtgtctggggatactgggaaagggtaactggagggggattcaatgtgtctgtctcatccaataagcactcatgacctcagccccatactctttcttccctatgttcccagagacagaatagacctggccccttccttctaggggatcacaatattggaaggatgaggactccaaacagccagctcccatgccaaatagaacgatgagtgctgggatcaatttctatgggagcctggggagagggatcctttctagttgaagggtggtnnggtcaaggaagacttcctggaggaagtggttttgatccacactttgaaagatgcatagactttgggataaactggggcaataacagttggtaggggaatcagcaggatccagcgcccagaaataaaaaagcccagagtgattgtggggaggtggcgtttcccaaggtggctgttccacagagtggatatagggaggtggtaggaagtgagaggagatgaagtgcacacgacagtttctaatcccagtcttgggancctaggatttgtctttcctgcag

SEQ ID NO: 57719 - DNA, 4578 bp, Homo sapiens
agtccctctttgggtgacctgtgcctgcttcgtgcctggtgtgacgtctctcaggatgcctgagccggggaagaagccagtctcagcctttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgaatgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctgcgtgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttcatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 57720 - DNA, 502 bp, Homo sapiens
aggagggcccatccgttcgctcattcagccactcgacaaacatcacgggcatgctccctgagccgagcggcaacaggacaggtttttctgcccaaaaggagccccgctctgggggagatggaggcagatgcatccagcagatttcctgcgacactgctgtacatgagccatgtccagagtgccgtgggagcactgagcagagagccatccctgtgcctgggggtgatgcctttaggaggctgagaagatggtgaggaaaggcatcccaggcagaggaaactgtgtacaaaggggtggaggagggaaagggccttttgggtgtggagaatgaatgaaacatgtcaggagaggactgggtggggttgggaggatcagagccaggacaggggtgaatatgggcagtgagaagccttaaagggttgacggagggctggcgacatgatcagaaatgcatcctgttgagacccagcctggacaacacagtgagactccatatcactaa

SEQ ID NO: 57721 - DNA, 4323 bp, Homo sapiens
agtccctctttgggtgacctgtgcctgcttcgtgcctggtgtgacgtctctcaggatgcctgagccggggaagaagccagtctcagcctttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgaatgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctgcgtgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttcatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 57722 - DNA, 2981 bp, Homo sapiens
agtccctctttgggtgacctgtgcctgcttcgtgcctggtgtgacgtctctcaggatgcctgagccggggaagaagccagtctcagcctttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgaatgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctgcgtgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcgtgagtgcccctttgtgcagt

SEQ ID NO: 57723 - DNA, 341 bp, Homo sapiens
tccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacaggttagcccttcctcagaggggagaggagagggcacaggctagcccttccctacacaggagaggagagggcataggttagcccttccccacaggggagaggagagggcacaggttagccccccacctcgtccacatacatggaaagagcggagtccggcttagca

SEQ ID NO: 57724 - DNA, 325 bp, Homo sapiens
ggggtctgacttggatctcaccccaactctgcacccccccagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcggtgaggccggccggggtccaagctggagaacacagaggggcagccccaaggagggcccatccgttcgctcattcagccactcgacaaacatcacgggcatgctccctgagccgagcggcaaca

SEQ ID NO: 57725 - DNA, 573 bp, Homo sapiens
tctccccaaacaatgctgggattggggactactggctttcttcccatttctgcagcaggcttgaggaagagctaggtgccagctcctttctctcctctggctctgcagattgacagttctaatttgtccaagtgagctcaggaaagagatgaaggactggtttgacactggtcaaacacaggggctcttgagtcaagtagctagctgcaggtcaaatttcagtgctaaaacttattctcaatgtcacttcaagaaagttatcagacctcatagtgcttcagtgttctcatctgtaaaatgggtctaatgacaatactaacttctatttcataacagttgctttgaggtcgaaatgagatgatatatgggtgctgagctaagtgtaagctaagcattcagtgaaagttagctatgatttttctcatgactgttttatgatgaagaaatccagagggaagctgggttagctgaggtccaaaggaaaagtagctttgttttcacgagcgtcctgtgcaggtggagcctctgcatattgttcttggtggggactcagggcaggggcaggcaggctga

SEQ ID NO: 57726 - DNA, 411 bp, Homo sapiens
catgagaattagaatcaccatacctaaacatctgagcaaaattcaaagaatattttaatttctccattttcttccctttcccttcatataacgagtaatataagaggtattaggaaaacccctcctccatggaaagatacttcagagcactctgtattctgggtttataatgcgttctcctcttctaataacagctttgagatacaatttcagtcctcacctaacacccctgacccaagggcatcaaaaacggtacaaagaatagagaagtagagaagtaatgagtgtgccatactgttatttgttgctaatctgggctttgtgattaagggaactaatatcaaaagcatggtaaaatagaggtatattccagtactgatgatggtggtgatggtgatgaatgacagttga

SEQ ID NO: 57727 - DNA, 224 bp, Homo sapiens
tgctgaggtgatctagaggatcttcaggtagaactaacacccctgacccaagggcatcaaaaacggtacaaagaatagagaagtagagaagtaatgagtgtgccatactgttatttgttgctaatctgggctttgtgattaagggaactaatatcaaaagcatggtaaaatagaggtatattccagtactgatgatggtggtgatggtgatgaatgacagttga

SEQ ID NO: 57728 - DNA, 1058 bp, Homo sapiens
attgaaagaactaacctgcagaaaaggctgctgcccttcaaactgtgtactgttgtctaagctagttcagaagaatacacgagcttccttcacatactccaatctgttggtttgacttctgaagaaccagcagagttggaaaggcctcgagatctctgtcctggtgctggcctggggctcccctaggtctcgcctgaaagtgtcccattcaccaccagtcttctacaatgttatccggaatggaacgaagtactacacccacaagtcctgaaggtactgaccaaaacaggagggagagacgggaccggggctgctgtgactggaggctgatggggctccaccgtgccccatcctctcatcccacagtcttccttcacatctgctctgcccaccacagccctgctctggagttctctgctctgccacttctgccatccccacctaggcagacaggtttcatccagcctccaggacggcccacccacttgctcctgcagcaggctgctcttcccaggtgcacagcccagagaattaagtgcatatatttaccagaagacatgaccaaagccattcctggggttgccttcatgtagccaacatctggaactaacaccaaagttcattaggcacaaaataaaagagttatctggaacagagtcctccatggaataacacgtcataaacaagaacaggctggtcacggtggctcacgcctataatcccagtattttgggaggccaaggcgggtggatcacctgaggtcaggtcaggagttcaacaccagcctgcccaacatggcgaaaccccatctctactaaaaatacaaaaattagccaggcatggtggtgcacgcctgtagtcccagctactctggaggccgaggtgggagaatcatgtgaaccctggaggcagaggctgcagtgaggtgagattgagccaccacactccagcctaggcaacagagaaagactctgtctcagaaatacataaataaataaataaataaataaataaataaataaataaggccaggcgcagtggctcacgcctgtaatccc

SEQ ID NO: 57729 - DNA, 729 bp, Homo sapiens
atcaacgagagtgcctgttacagacaggttccttgacaataccaggtgttggcaaggatgtccagcaagtggaactccctcacattttgctggtgggaacgtaaactggtaccacttgggaacactgttcagcagaacatgctaagagacacatcctctgacccagtcctttatttaacttctaggtgcacagcccagagaattaagtgcatatatttaccagaagacatgaccaaagccattcctggggttgccttcatgtagccaacatctggaactaacaccaaagttcattaggcacaaaataaaagagttatctggaacagagtcctccatggaataacacgtcataaacaagaacaggctggtcacggtggctcacgcctataatcccagtattttgggaggccaaggcgggtggatcacctgaggtcaggtcaggagttcaacaccagcctgcccaacatggcgaaaccccatctctactaaaaatacaaaaattagccaggcatggtggtgcacgcctgtagtcccagctactctggaggccgaggtgggagaatcatgtgaaccctggaggcagaggctgcagtgaggtgagattgagccaccacactccagcctaggcaacagagaaagactctgtctcagaaatacataaataaataaataaataaataaataaataaataaataaggccaggcgcagtggctcacgcctgtaatccc

SEQ ID NO: 57730 - DNA, 2219 bp, Homo sapiens
  misc_feature (175)..(175): n is a, c, g, or t
acttaaaatgaaggatgaattgacatctgggatgccagaagacttagaagttattttgtttgcttgttttgtttgggtatttggggatttttaaaaaataatcaaagtggaattttctggtactgctttaaaataattattgtggtctttcagcactttacacgttctaatttcntgtcctatggaagttctcgctgtctccatctctctcatttttgtgtcacctaatatgttggtacagataagagttagtcacatttttctgactgcatcaaacttttatttgaaatggtactggatcttagtttctgtgcagaatattctgtgattttgggaaatgtaagtgagtccacttgcttctggaccaattctgtttcatgtatgttagcatcctagaaacacctagcaatggacctagttcacagtaataggtgcaaagaaagaccaaatggactttgcagtattaaccctttgcagtcgtcatacttagctgctgcctgtaatgctaaaatgattttaatggttgtctggaggcaaagggctgttttttagtatattgccactaaaggacatttatttatatcaaacttttatttttagatattataagcatacagtacataattgatgaaattgatatttactagagatttatggtagagaatggacgacattcaataactggagcccgagattgtcactttatttaaaaagacaaataatcatctgacaagacagcactgttgccattataaggagaaatagattacaatccttatcatgtacacgttagctatgttccgtatggccacaggactttcctgaaaccgtatctgtctgcttgaagtagacttatgtttgttgagaatgaacaggcttatttgagcctccagggtggcagttcataaagacagctaagttctgaaggaaaaaaaaaatatatctttttaagtggctagagtcattattacaatcttatactgtgaaagtccaagaaatcaggcaacattgtttcctgggtcttttcagagatcttatagatttatgaagtgtttttaatccatgaagaaacactaaagtgcctttctttcttcaaagcaatattatttccaagtatattaatttgttagaaaactttcccataggaaatgttgtcaagttacctgtactgtaaagagttatttatgttcagtagtcaagattttctacatggacataaatcactctcacgtgctctcagcagaaggcattagataagcatatacaagaattgggtacttttatacaaatatgggataagaaatacttgcctgacacttttccatggctgagtctgaccattacagtaagaacaagaattgaagaggcattttgcacacagaaacattctcactttaaaaaatggtattggttaccttgaaggcatagataatgggcctgtcataaaattatcaattataactggcaccgagggactgccctttttaagctaaactaagccttatctgcttaaggatgttgaactgaatcactccctttactcatcctgtgcatatgtgtacaaatggtcatgtggatcatgtgatgatcatccatcttatttgattgtattaatgcatcatgctaaacatgtagtacaggttaacaataccagatttatgtcctgttcaacaactcagtactctaaatgttgttatgcttttaataagaccttcccagataataatcttggagctcttttcccagctgtctaccatgcatttgcaacaggaggaagatgtaatgaatatgcagtattaagttgatttatgaacagtgctttgatatgccaaagggaaaactgtcccacttaaattagattaagtagggtggctaaaaataaataaaaacactggaaattctttctctcactttctcttgatgcaatgaagggaatatgacactacagtatacagagttgttgttatatgatgcacaaaatattttgatgatttgaataaatgttaacttttaatctgcgccttaataatgactggttatctgtaaatatagaacagatacagattgtatttttctgtgggtttttgtccttttagtgatttttttccaaaaacgagagatggaattaacattgaaaatgggaaatttttctaactgaatcaattgttacatgaaaaataaatttatataacccctttgtattgctcttgctataaaaa

SEQ ID NO: 57731 - DNA, 704 bp, Homo sapiens
tctggttcgaatctagcaggatccccatctacgtcgcatatgtgtacaaatggtcatgtggatcatgtgatgatcatccatcttatttgattgtattaatgcatcatgctaaacatgtagtacaggttaacaataccagatttatgtcctgttcaacaactcagtactctaaatgttgttatgcttttaataagaccttcccagataataatcttggagctcttttcccagctgtctaccatgcatttgcaacaggaggaagatgtaatgaatatgcagtattaagttgatttatgaacagtgctttgatatgccaaagggaaaactgtcccacttaaattagattaagtagggtggctaaaaataaataaaaacactggaaattctttctctcactttctcttgatgcaatgaagggaatatgacactacagtatacagagttgttgttatatgatgcacaaaatattttgatgatttgaataaatgttaacttttaatctgcgccttaataatgactggttatctgtaaatatagaacagatacagattgtatttttctgtgggtttttgtccttttagtgatttttttccaaaaacgagagatggaattaacattgaaaatgggaaatttttctaactgaatcaattgttacatgaaaaataaatttatataacccctttgtattgctcttgctataaaaa

SEQ ID NO: 57732 - DNA, 626 bp, Homo sapiens
ccaggtgtgatatactgcacggggaccagcctctatacgattccaggtgttctatatgattccaggtgtgatatactgcacggggaccagcctctatacgattccaggtgttctatatgattccaggtgtgatatactgcacggggaccagcctctatacgattccaggtgttctatatgattccaggtgtgatatactgcaccgggaccagcctctatatgattccaggtgttctatatgattccaggtgtgatatactgcatggggaccagcctctatacaattccaggtgttctatatgattccaggtgtgatatactgcaccgggaccagcctctatatgattccaggtgttctatatgattccaggtgtgatatactgcaccgggaccagcctctatacgattccaggtgttctatatgattccaggtgtgatatactgcaccgggaccagcctctatatgattccaggtgtgagcaccgtgcctggcctatatatgattccagttgtgagctactgaatctggcccagcccatctgatcttgcatgttgtccacgttttccatcacagcctttaatgtgtcagtcatagttatttaaaatcccctttcaaatagttccaa

SEQ ID NO: 57733 - DNA, 926 bp, Homo sapiens
attgggccttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaaca

SEQ ID NO: 57734 - DNA, 891 bp, Homo sapiens
tcatgtttaaaaaaagtgacattgcttttattactatttggcggggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcag

SEQ ID NO: 57735 - DNA, 4384 bp, Homo sapiens
attgggccttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgtggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcag

SEQ ID NO: 57736 - DNA, 5115 bp, Homo sapiens
ccgagctctctcctgatggtctctctggggcgcccctgcaatccgcttccccctcccgcagatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgggaccagcctgggactctgtccctttcccaatttcctcttctcccaaagctttctctcccccaagaaagcatccctggagaaaagtctttgcccctctgaccttgccctctccccagctttcttggtggagttgggatcgtgatcatctatactctgaattagtactgccaacctgggctttctgtaaaggtctttcccaccctttaccaggagagatcctttctagaacacactcatccatgtctctctgctgttccctattgacagtgtgatagattatcacattatctaggtgtggcaacctaggttttattcttggggtttgcttttcttgtgtaggagatgtggccctgatatttcaggcagggctagtagatagattatgtatgaaggtggttctcaaaatttggcaggtagcagaatcatcggggcgtcttattaaaatagcgatttctctcagcattcctgcattggtggtggggcggggggagaggaaacctgagaatttgtagttttcaaaagttcccaaataatgctgatgcaaataatctgaggaccacattttgacaaccactggtgaaagggtatgaatacatctttgaggcagtagccactagaggtttagaagcagatgtgggaaagattaattgatagagctagataatatgttttgggtcattttcctgcagaaggttgggccactaggctttagtgaggtgtgagccttgggcctggttctgctggagtattaaggggtgaggcctgatctgctggagaaaggatggagttaagggaatgagccacctggggccctagtgtctcctgtctccttccttttacaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgtggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcag

SEQ ID NO: 57737 - DNA, 2870 bp, Homo sapiens
cgagaatctctactaaaccacatacgttatgactctcggaatcccattcagtaactgaaacatgttcgaagacttgatttcttacgaagatcctgagtgcattgaacctgagtgtcgttgagagtcctcattgcaactgaataagacgttccgtgggaaaccgaggcgttctagacagctaatgtacaaatgggagcttctgagggtccatctacgtgtgatctatcaacagcgaagtgccaatcgaggctctgattatcagaatgtacagcgtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgtggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcag

SEQ ID NO: 57738 - DNA, 2577 bp, Homo sapiens
ccaacctgggtgacagagtgagaccctgtctcaaaactactacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgtggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcag

SEQ ID NO: 57739 - DNA, 1848 bp, Homo sapiens
  misc_feature (1815)..(1815): n is a, c, g, or t
attgggccttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaaggaaaagttcttgaaggaagttaaaagtgctactccagtaaacacaaggccctaactcccttcaatgctataaaggctgagaggtgaggaagctgcagaagaaaagttggaagttacccnaggttggttcatgaggtttaagggaagaagctg

SEQ ID NO: 57740 - DNA, 5230 bp, Homo sapiens
attgggccttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgggaccagcctgggactctgtccctttcccaatttcctcttctcccaaagctttctctcccccaagaaagcatccctggagaaaagtctttgcccctctgaccttgccctctccccagctttcttggtggagttgggatcgtgatcatctatactctgaattagtactgccaacctgggctttctgtaaaggtctttcccaccctttaccaggagagatcctttctagaacacactcatccatgtctctctgctgttccctattgacagtgtgatagattatcacattatctaggtgtggcaacctaggttttattcttggggtttgcttttcttgtgtaggagatgtggccctgatatttcaggcagggctagtagatagattatgtatgaaggtggttctcaaaatttggcaggtagcagaatcatcggggcgtcttattaaaatagcgatttctctcagcattcctgcattggtggtggggcggggggagaggaaacctgagaatttgtagttttcaaaagttcccaaataatgctgatgcaaataatctgaggaccacattttgacaaccactggtgaaagggtatgaatacatctttgaggcagtagccactagaggtttagaagcagatgtgggaaagattaattgatagagctagataatatgttttgggtcattttcctgcagaaggttgggccactaggctttagtgaggtgtgagccttgggcctggttctgctggagtattaaggggtgaggcctgatctgctggagaaaggatggagttaagggaatgagccacctggggccctagtgtctcctgtctccttccttttacaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgtggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcag

SEQ ID NO: 57741 - DNA, 2338 bp, Homo sapiens
  misc_feature (2153)..(2153): n is a, c, g, or t
  misc_feature (2160)..(2160): n is a, c, g, or t
  misc_feature (2285)..(2285): n is a, c, g, or t
attgggccttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgatggcaacagtcaagatggtgtgatgaganagatggnaggggcacaaagaggaggacccctgaaggagcagagtccatgagaaagaaggagggatgggacctttgtaggaagagacacagtcctgctgtccccgcatcattgggcctgagtgtgctctgtanacaacgtcatgtctgttacaccaattaaagaagcgggaaggcttcaaaaaaaa

SEQ ID NO: 57742 - DNA, 1674 bp, Homo sapiens
attgggccttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggcagatgcctgcttttgcttcccct

SEQ ID NO: 57743 - DNA, 413 bp, Homo sapiens
tgtgataaccacaatgtagaaagccattcccaactttttgaccattttaggccacttaaaatgttttatcccttcctaatttattgagtccttactttttaaagcacttcacatgtattatcttatttcctccttacaacagccttatgagatagacactcttgttgtccccactttacagatgaggaaacagaggctgagtagctggcctgaagccatcgactttatataaacggcagagacgggatacggatctgggcaataaccattcttgtgtctcagtatccattcctgtgtgtacttttttttttgaggcaggagaatggcgtgaacccgggaggcggagcttgcagtgagtcgagatcgcgccactgcactccagcctgggcgacagagcgaaactccgcctcaaa

SEQ ID NO: 57744 - DNA, 799 bp, Homo sapiens
ctttagtatttccagaactattgctgtagaggcctcccttaattttcagagttctcattttgaattaaagtagacttacgctacatagatgtagaaaattaggtttggcttaggtttctgaaaaaatattctaggagaaggtggtagcattgttctgaacttaccacacttggaaaaactaatcttcaaatgtaattttttgtcttattaatgagtaatctgtcaaagacatgaattctttgacttgtgctcattctttctgaacttattgaggcttatatatatcaaataaggttaatttacacaataattatttttaataattaataaactcattcatgtagtatattttaaaacattatttcctctcatttttccttctcttttttcttcctatatatttttaaggtttcaagagaaaacgggcttcagtttttaaaaaaatgtagacttgcatttttactgtgcttatttaaaataatggatataatttatattaaggtccaaattattttattcacaggataatcatggtctctgataaaagatgcccacatttctgtgtactcacagttgttgtatatttttcaatttcaattttgaaagtaaactcaacacattgttttcccattttacctccactacctactcgccagacaaaaatatagatttctctaaaaacacatacaaagaaaacgtctttccttaaaacatgatcttattgacctggaaggtagtttgagcaagggtatgtaataaaataaatggctctcaacctgcatcaatttttatactatag

SEQ ID NO: 57745 - DNA, 217 bp, Homo sapiens
tattcctacaaactgggtcccctgcaggaaaaaacgtgcccttcagagtgccagaaagctagcctgggggacgggcctggggctggggtgggcaggagtcctcgctgcacctgcagccttggggcccctgccgtgcctatgctgcagtcactgactccttagacctgtgcctagtctcctactgaagggctaccccatgcttctgatgctcattaca

SEQ ID NO: 57746 - DNA, 1607 bp, Homo sapiens
tacacacacgcaatgacccacgagaaagggaaaggggaaaacaccaactacccgggcgctgggctttttcgacttttcctttaaaaagaaaaaagtttttcaagctgcgcgggcttcctgtgcgcggccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccataaaatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataaaatt

SEQ ID NO: 57747 - DNA, 1553 bp, Homo sapiens
tacacacacgcaatgacccacgagaaagggaaaggggaaaacaccaactacccgggcgctgggctttttcgacttttcctttaaaaagaaaaaagtttttcaagctgcgcgggcttcctgtgcgcggccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccataaaatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataaaatt

SEQ ID NO: 57748 - DNA, 1553 bp, Homo sapiens
tacacacacgcaatgacccacgagaaagggaaaggggaaaacaccaactacccgggcgctgggctttttcgacttttcctttaaaaagaaaaaagtttttcaagctgcgcgggcttcctgtgcgcggccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaccacataatacggttgtgcgagcagagaatctacctttccacttctaagcctgtttcttcctccataaaatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataaaatt

SEQ ID NO: 57749 - DNA, 555 bp, Homo sapiens
atttaatgagctccttcctttcaacagaaaatggactattttcctttcagatttactatatgctgtcactccagctttataaccgcatgtgcatacacaaacatttctttctctcttgcaggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcatt

SEQ ID NO: 57750 - DNA, 276 bp, Homo sapiens
cccccttggcagtacctccccctcataatctggatctctccacttttgggggtctcctctttgaacctcatctctcttctgtctgtacttgttcctgtgatctcgtctcgtctcgtctcagggccttttaacttccacacatacaccaatgactcccacatttctgtctctagcccagacctctcccctaacttctagactcacatattcaactgcctacttatcatttctacttggatactgatatgatttggctctgtgtccccacccatatct

SEQ ID NO: 57751 - DNA, 208 bp, Homo sapiens
ggagactgttggacctctgtctttaaagaccatgctatgttgcaaactctccctcagtttttataactgaagtccaggttttagttgtgcagtttgaatatgaacataaaccttccagcatgctatatttatgcaaagtaagaaatattatataccagaataaccactactggattattttgaacatagaaattaaataagctaatga

SEQ ID NO: 57752 - DNA, 311 bp, Homo sapiens
gacagagttagaatctgtctcaaaaaaaaaaaaaattaaaaattagccaggcatggtggtgcacagttgtagtcccaactactgaggaggctgaggcaggaggatcacttgagcccaggagttcaagactgcagtgagctattattgcaccactgcactccagccctggtgacagagtgagacctcgtctcaacaacaaaactaattaaaatcaagaagtagcttgtgagccagggggtggggtgggaatggaagatcccgttatcagaagctatagcctataactaaccaacttttaagctattcagcag

SEQ ID NO: 57753 - DNA, 159 bp, Homo sapiens
gttctgttttcaaagttgttctccccttgaggtcccagatgaccggctgagctgtgcaagggccacggctccaaggaaggccggagctacttggaggttgtccccaggccctttgtccacagtgacagacacccagaccagaccatgctgcagtgactg

SEQ ID NO: 57754 - DNA, 338 bp, Homo sapiens
tcctgagttgaataggagggagagttaagccatcctgagttgaatagggtctggtgcccttccggagcccagagtgcctgcccggctgtggttggcatgtttcccagggctgctggtgcccttggcattgtccctgccctgtaaaggtgacctggcctcagattcgccactgccagggcagggtggctgccagggctcgcctcagaatctgggagcaaagccctgtaattactgtatttggtcggtgaagcaggtgttggaggagaaaagggtgatatgggggtttggaccagacatcggtagcaggtgggaagtaaatgagtttgccttcacagagc

SEQ ID NO: 57755 - DNA, 973 bp, Homo sapiens
attgaatgcagcaagggtctggaggctgaggaccaggcagacaaacattcagagttgctggaatgcgacagagacagggagtcagactggtcatgcaaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctcccc

SEQ ID NO: 57756 - DNA, 1103 bp, Homo sapiens
attgaatgcagcaagggtctggaggctgaggaccaggcagacaaacattcagagttgctggaatgcgacagagacagggagtcagactggtcatgcaaggtcctgggcctgccttgggtcctggggagccacggaaggttgtgggtgccagagggttgtggtcagagccacagtcaggggccttctgagacctgtgccccctccccaccctccctccccacctccctaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctcccc

SEQ ID NO: 57757 - DNA, 395 bp, Homo sapiens
atatgtgtgttgtgcactcatgtataggagagacaggtaagctgaacaaaaaatttaacagattgtcccaaggagtgggcaggggattataattcacttcatttttttctttatacttttctatattttcttaactttttatagagaatctatatttgttttacaatatgaaaaaaggcaacaaaaattctctaaagaaaaataggtgagaaagagaaagccaaaccaagcgtaaagacataaattgaagcccatgatgaggctaaaacaactgaatttctatggccaagccatgcatttggagctcaattttatagcagtcaatggatgaggaaaacctgatcagttacacgggtcacggggtccacaggacatacaaagcgattactcagaga

SEQ ID NO: 57758 - DNA, 468 bp, Homo sapiens
caaagtgctgggattacaggcgtgagccactgcgcctggcttctctttttcttaataataactagagcctctggaatctctgtgaaatctcgtatctttatcttctcaaatttttgaatgagcaatggtggtgagattgaggaaatcataataccagcattggaaaagattttgaagaagaatagaaggctcaccaataacatgttagtgcctaatgaagggtttattccatctgatttacagaatagaccagacaagacaatcatttcagagccttttacctgtgtcagggtatgacagccacagcccttgttttaaagatcacctttgtctaatccccattacctggacttacaaatttccccccttaatgttttacaggtttacctatgtataaatgtgagatatgtttaaataaaatgttaatacatgtttaaataaaaattcctgtttaaatgaaaatgcact

SEQ ID NO: 57759 - DNA, 364 bp, Homo sapiens
atgccaaaggaattcatcaccactagactggtcctacaagaaatgctcaagggatttctaaacatggaaatgaaaggttgacactcaccatcataaaaacacatgaaaggataaaactcacagatcttataaaacagttccacaactgagactacaaagcaactaggtaagttaacattatgataggaacaaaacctcacataccaatattaattctgaacataaatgggttaaatgctccacttaaaagatacagcttggcagaattgattaaaaagcaggatctaatcatatcttgcttacaagaaatccacctaactgctaaagacacgtaaagactcaaggtaaaggggtggaaaaagac

SEQ ID NO: 57760 - DNA, 1055 bp, Homo sapiens
  misc_feature (985)..(985): n is a, c, g, or t
  misc_feature (995)..(995): n is a, c, g, or t
  misc_feature (1017)..(1017): n is a, c, g, or t
  misc_feature (1028)..(1028): n is a, c, g, or t
cccactccctacaggccccagtgtgtgatgttcccctccctgtgtccatgtgttctcgttgttcaactctcacttatgagtgagaacatgcagtgtttggttttctgttcttgcgttagtttgctgagaataatggtttccagcttcatccatgtccccgcaaaggacatgaactcatccttttttatggctgcatagtattccatggtgtatatgtgccacattttctttatccagtctatcattgatggacatttgggttggttcagtttcctctcacaaaggaaattagggaagcaatgaagataataggaatttataagttaggaaacaaaaataatagaatcagtcaatacaagagctgtcgtttgaaagtcctattaaattgataagccattggccaaccaagaaaaaaagggggaagaaaagacatatatttaaaattagaaaccagaaggggaaaataatcacaaacatcagcaaaactgaaaggatctacaggagtaccttgcaaaatagatgtgaactaatgggatgaaatggttgattttccagaataatgtaaatcaccaaaatgatcccagaatagggaaaaatctaaacagggcaatataaacatagaagaaaatgagaattttagcaaatgagtatctttcaaaaatgtatcaggcccagacctttttacaagttaactctttcaagccttcatgggatataattctgacactactctaactttgtcaaagaatagagaaagaagaaataacttctgaactatctttacacaatcagtataatactgataggaaaacttgactgagttcagaaaaagaaaacgaagtagagatctcacttgcatcagaacaaaatgtcaatctattagcagataatattcatcagtattttttgaaaatacaataccacaagaaagaaacagtggacatttggagggctttgaggcctgtggtggaaaaggaattatctncccgtaaaanctagatagaagcattctcaganacttgtttgtnatgtgtgccctctactgacagagttga

SEQ ID NO: 57761 - DNA, 289 bp, Homo sapiens
atgattttaacgtagaaaaacatgccctgtttagtaaggttaaggacctgggtttatttagcttagaataaatgactaaattgaaactgaatacctatcttcaagcatttggtagtggccagctttcctttagctctgccgaagacacacaaaaaagaaattcaactgaagtgtgaagaatttaagttagagattgcaaactgacaatataaagctacgttggctctcagagacatattatttggaccacacaatatattttaaaagtttgaattgtttgcaaagttaa

SEQ ID NO: 57762 - DNA, 1654 bp, Homo sapiens
  misc_feature (668)..(668): n is a, c, g, or t
gtatctttgaaaatagatacgttcacaccctcctaacggcggcgccaagggtggtgggtcccaaaactgtttccccgtaaagagttcccccgcccggtcgcaggaagacgcctgagggggcgctcggagggatccccagcagccgccggagctggaccgtgcggtgcgcgggtgagaagccgggaggggccggacaaccccgaccgcgagccggacccctgctctgaccgcaggtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgttttnattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaacttt

SEQ ID NO: 57763 - DNA, 357 bp, Homo sapiens
attagctgccattcagcttaagccgagcagtgaacttgtgacctcttatttcaggttcatgatgctttgaaactcagccacaggaagcaaagatatgggtggcaaggctgggcacaatagctcacgcttgtaatcccagcacttagtgaggtcgaggcaggtggattgtttaaggccaggagttcgagaccagcctgagcaacatagagagacccccgtctctacaaaacaaacaaaaatagaacaaagcaaaaaccagccagatgtggtggctcatgcccagctactccagagcctgaggtaggaggatcgcttgagcccaggaaattgaggctgcggtgagctgtgattgcacca

SEQ ID NO: 57764 - DNA, 171 bp, Homo sapiens
ctgacttgcccaaagtcacacacttagtaaatagcaggcctggcctttcaaaattggtttttctgactcctaaatctgcactctttctacctcactaaacttcctcttgaaaagatttctatgaaatttcccagatgcatacaaacgttataaataaaaatataggctggg

SEQ ID NO: 57765 - DNA, 987 bp, Homo sapiens
cccaaagtgctgggattacagggtgaaccactacacccggcctattagaattttcaacagcatgtaagatcaagttttctagaaagagttataaacttagtatttcttatctgtcagatatttgaagtaatctatgtagtagtcagccaaattatttctctgccaacaaaaggttaccccattttccctaagcaataatgtctaccgtctgttactatcattatggtacagctaatttgggatgctatcaatcagccaggttattagcaaccaggtcagtttggttttcttatattttctactttgtctatctagattagaatggctttaaatcaggatttttatttcttggtcagtgaatcaaatattgggttattggctttatgctactttaggaccaaaaatatctatatgagccaccgcgcctggccaaaagaatgttcttgagctttatattttgacccaaattaggcaatagttaccttaaagaaaaatgatacagtcaaaatcattttggctttattaaagctcctcaaaaaactctagaattagggctttcttaagttactttttagcagaaacatttacggtattttgtacatatgtgtgcaaagttgcttattaacatttatgtcatggtcataaagactaatttggtaacaatattcagtctccagtaaatatgtggttaattgatatgcaaattacttccaaagtacaaattaatagtctcatattacatttttgtgctttgctacctttacctcaaacaaaataatctgtaggattcttcatgcttgtttcagcaccttttgcccagctttgcttgcttcattggccagaggactgtcagcacctcatgaagccctttatatgcttctctgaggtcatttgcataatgttgtggcctatagtaggttctcaataaatacctgatggatgaatgaatgaataaggatgaggaaatgaacacggtaggtatgcctg

SEQ ID NO: 57766 - DNA, 724 bp, Homo sapiens
cactggatagaggagcgattgcagagaatcctcaaagttgcctttgaaattccctagctgaggaaattaaaagactgctctttctagtcttgaactcctgacctcaaatgatccacccgccttgcccttccaaattgttgggattccagtgagccaccgcgcctggccaaaagaatgttcttgagctttatattttgacccaaattaggcaatagttaccttaaagaaaaatgatacagtcaaaatcattttggctttattaaagctcctcaaaaaactctagaattagggctttcttaagttactttttagcagaaacatttacggtattttgtacatatgtgtgcaaagttgcttattaacatttatgtcatggtcataaagactaatttggtaacaatattcagtctccagtaaatatgtggttaattgatatgcaaattacttccaaagtacaaattaatagtctcatattacatttttgtgctttgctacctttacctcaaacaaaataatctgtaggattcttcatgcttgtttcagcaccttttgcccagctttgcttgcttcattggccagaggactgtcagcacctcatgaagccctttatatgcttctctgaggtcatttgcataatgttgtggcctatagtaggttctcaataaatacctgatggatgaatgaatgaataaggatgaggaaatgaacacggtaggtatgcctg

SEQ ID NO: 57767 - DNA, 353 bp, Homo sapiens
ttaccaaccagagagagtgggctgggatgcagaaactaattcttactcatgacactgatgagatttcctgagccccacctgtagtctctggaatagtaccttcatttccaaaaaggctagtctcaaggccttgagtacttctattcaacttgcagataagctaattcttctatctgatttgaaattactacatccttgccaggctaaaaccgttccttcactgcttaatttcattctcattttcttgaccatcttaagacagtgcattcatatcttttgtctggttttatacgtacatctatctgatccttcatactcaacctttaattcttttgtaagctcttttaccatta

SEQ ID NO: 57768 - DNA, 292 bp, Homo sapiens
taaaatctagagaacatgaaaaaagggaagaaaacaaacctattttaaagcttacgtgactactttttaatgagttcaggaaaaagatgatgaaagttattgggtattcccatggaaaagagaatagagatggtaaaacttcctttctaggaagttaccttctaggaagccacagagttgccatccttcttactgtccagagggaaaattctagagttttctgaatttgcactcttttgactttgaagcagaacaaattaagtttcaactgacccaagtcctaaggatacta

SEQ ID NO: 57769 - DNA, 283 bp, Homo sapiens
atcctatttttgttttacatacgtactgatttttctcatttctcttaaggtactttgtttgcctgttttattctttctttcaggctagagatttccacccttaactatatactcagatttgaaactagagcacataccaaaaaaaaaccattaagagcactgtgaatacaggtcaagctttcaaccaagccattttatcaagggaattgctgaaattagcatatttagaatttgcttttgtttttccccatctcttggacttttcagatttccctaagaagaa

SEQ ID NO: 57770 - DNA, 317 bp, Homo sapiens
attaagtcttcctgcatcttactgatggggaaaactgagggaacgctacaatggtgtattcagacccgtcacgagagctaaatagagtgggagcagagaaggaaaaggttggcctctgaaaaatatactcagtacagggcactgacggtcaggacctcggcaatgttggtaatgaaaccgccattgcaaaataatgactgagacagtgaaagagatctgacctgactccgccttgcttctaacctccaagctgtccttgtttattcctgggctgagctaactttgggagggacttagtttatagtttaaaacaaaga

SEQ ID NO: 57771 - DNA, 318 bp, Homo sapiens
cagaaaccccaacaaaggccatgccttacaacttaccttgctcctgtttctgcctcctgaccactctggtcttccccatgttgccatgtatggcatgcctcctgtctctaggacctatgcagcaaaagagaaaaacaatgaaagtctgtattagtaaccagaaaaacggtcagaagtctgaggtacctgagagaagacagcaaaatgagatctggaatttgaggagcacctgttaggagaagagccatctctactactccccaaaagattccctgttctagttggccttctatattggtggtttctgaatacataccc

SEQ ID NO: 57772 - DNA, 345 bp, Homo sapiens
agagtatctgactcacagtgacacaagtttccatggtaccctggaaactggatggttttataatgagacagacctaagttaaattccaactcctctgcctcttgttagctgtctgactctgggagagtcagttcacttctcaaagcctcagttgtttcttcatctgtaaactggggagaaccacatttatctcacaggattgccatcaggtttaaatgagttaacatgtgtaaagcaattagactaaagctgggcacacagaaggcatccagtaagtgttagctgccttctctcctgtgtttactaggtgaaagtcattttgaacagctgtttgctttttcctgc

SEQ ID NO: 57773 - DNA, 351 bp, Homo sapiens
ctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtatttcttaatacactagaaaggggaaataaagtacacaagtccaagtctaaaactttagtacttttccacgcagatttgtgcacatgtgagagggtatccagtttgtctagtgattgttatttagagagttgaac

SEQ ID NO: 57774 - DNA, 351 bp, Homo sapiens
agaaatcccgtctctactaaaaatacaaaaaaacttagctgcgcgtggaggtgcatgcctgtaatcccagctactcgggaggctgaggcaggagaatcgcttgaacccaggaggcggaggttgctgtgagccaacgttgcaccattgcactccagcctgggcaacaagagctaaactctgtctcaaaaaaaaaaagaatagaatttgaagttggaagagaattttaaaatcatataatcaagccctttctgtctacagaggagcaaactacaacccgtagaggtgaagcaagcagcctaacatcctgcaatcaggtggttaacatcagcgtcaccactggaacttagatat

SEQ ID NO: 57775 - DNA, 306 bp, Homo sapiens
cccctaagccaggaatcgaactctgaacccaggctgtcattgtgatggtggagaccaagagaaagtactgccaggtcagggggatcacaaggtcaggagattgagaccatcctggctaacacggtgaaaccccatctctactaaaaatacaaaaaattaaccgggcgtcgtggcaggcgcctgtagtcccagctacttgggaggctgaggcaggagaatggcatgaacccgggaggcagagcttgcagtgagccgagattgcgccactgcactccagcctgggcgacagagcaagactccgtctca

SEQ ID NO: 57776 - DNA, 418 bp, Homo sapiens
atttacattacttataaaattacttttaggagtttctgttgattgttgtcctgagtatttgctgcattactttgattagttttctcttctcctttaaccctttgatactaccaaattctctcccactgcaaagtaggagcgagtggactcagtgggccacaaagtcttttgctcccctgaactgggctacagtccagagggcttggaaaccacaacttggagtaaatgtttcctaggaattcagctccacttcctccctcctgggtcacttcagcgaaagcctctcaagggtaggcacaaatactccacaggggggcacccctgcacccaccctctttgggcagctcccatccgagcagcatcatccctggtccagaattcagcagatgcctctgcaggcatcagctgggtgccacag

SEQ ID NO: 57777 - DNA, 685 bp, Homo sapiens
gaattcagtgactttttgcttgagaaaattcatagcgaatattctttgttggatgaaaaacagggcagtgatgccaactgagaacgtttttcttttcagttctgggactgactttgagagagaaggaacaccttgtgctctcatggtgcgctgctcacatcctaagcttagtatcttttctgagagagagaaacatgtggtttttccagtttgggcctattctgacaagactctgctgttgagtttataggctgattaaagggtacagagggaactctgtaattatgctcatacttgaacatggctatatatcatgtttgagaaatttcctgtattcaaagaaaataaccaagctggtcctatgttctgttttgcctgcgtgccactaagtgagaaaatgtatgttcctttcctgcttcagctgttgtttactttgtacagaattttctactcctttgaaaacgaccatttttctgactcttatggtttggtgagagtctgagaaaggctttggctttaagaactttcctggtggtttaagtcaagcttgagagagaaagtcattgttctccctgtcctcatacttcccttttcagcttccttataaagatgggtagttatgacctgcactctagctaagtttatcccaacagtcttgaactacttgtcaacatttatgttttcc

SEQ ID NO: 57778 - DNA, 370 bp, Homo sapiens
aacaaaaaaaactgttcttgaaaattgaagcattaccttgtataataaagtacatcaaatcagatttgtaaataaaatattgtttaattctaaagtattcaatattttgattagattatttttttaaggaaaaatatttaacgtgtatgtgccgaattttttttaaatagttttttataattgcaatggaaaggcaattgtctcattacaaagtggtacagaagccaatacttgggttaccatagatatataaacaagcaaaaactgtggaacacgttttaagctcattttggaaaattaaaacagttctgtagaaatgcatatttgtatttgtttctctaataaatctgcaaatagctttaaacacaaa

SEQ ID NO: 57779 - DNA, 452 bp, Homo sapiens
atattaaattattttccttttccgtcaatagtccaatctgccataatcactcttctcatttctattattatatatttatattgcctttcttgaacttcatatacatggaattatacagtatataatcttccttttgttttcagctttatattttaatgaataacatcacagtcatattttcagttaatccttactgtaatccatgaagaaattattcttggccctcttttttacagatgaggaaattcactcatcgtgatgaaatgacatgtcaagagtcacattaacacgtaataaaatcgaggctcaaaattcattcttccaagtctaagttaaatttatcctccatatttttttctagcttcccttttgttcgggtccacttcatttttttccccacaattacgtactgaggcatttatgatatgataaagtgacattcttgaactaaa

SEQ ID NO: 57780 - DNA, 434 bp, Homo sapiens
gttttcttcatttattttctccccataaaacagtatgtacaagggtttgattcaggggagagaaaggatatatgaagacacattcttccctcttctattctcttacctggttagaaataaataggcatatagtcctgtttattatgggcaggaaggtaggtaaagatcacctaagtgcttatggcgtgttggctttggcacatggagaatgagtttttgatcttgttttctcggcatgtctgtttcatgagatgagcctgtaggaagagttactaggctccctgactaagcagcccggagtcttgaccaacagcaggctgtcaacaatcctaaatagcatatttattacggactcaaaatgaaatcttgaaaaacaaaaacacaatatatatgtcactgcatggacatccatcactttttctgagcctgtattg

SEQ ID NO: 57781 - DNA, 299 bp, Homo sapiens
ctggtgaaggatagaggggcttcagggtgggagattgcctagaagacatggaaggcagtgtggagggggctagaggggcagctgaggggaaaggagggacccaaggaacacagaggaaaagagctgtcggtgtaaggtcttgggagaacctgtgacagggaacggggggccaggaaagaagaggacattagagtaggggattggggaaagggtagaagaaggagcgcccagacctcaaggaaggcgtcgggttctgaagtgcttgaggggtagatatctggaaagctgggaatagggga

SEQ ID NO: 57782 - DNA, 569 bp, Homo sapiens
ggagggggcctccaggctccaaatacagcaagagaagccaagtcgagtcaagggacgtgaatgcaaggtggggacagggggcagaatttgtggccattttcacagactaccacagaggatgatgataatcgtgcccacttcatagagctatgaggattgcagcagtgtttttctattcttctcctgttcccacgagctgtgatctgcctagtaacaggtcctcttacttggcatggggttctgccatggagagctgaaatcactggtgtccacttagttcgatttactatctcatccgaggggacagagccatcccccccgccaccatgtagaaacaagtgaggcgccctggctcatgcctgtcatcccagcactttgggaggtcgaggcaggcagatcacttgaggtcaggagttccagaccagcctagccaacatggtgaaaccttgtctctactaaaactacacaaagtagccaggcgtgatggtgggcacctgtaatcccagctactcagggagcctgaggcaggagaattgcttgaacacagaaggtaggcattgcagtgagct

SEQ ID NO: 57783 - DNA, 292 bp, Homo sapiens
tctagaatcatatttccattcaagagtggcacacatttttccactaacattttttttttaaacaaaagaaaggccaactgggcattcccctatccattgaaatgttcacccagcacatgaaagctgaccaattcatgcaatgtattttgtttccagagcaggaaattccaaagggaagggaaaaataatcaaacaagtgggttttgggtctttccacacattaaccctaatcatgattccagtggtttgtagggttgggctaattttcccttctatgaagtcaaaggtttgg

SEQ ID NO: 57784 - DNA, 449 bp, Homo sapiens
cagatatgatatatctgtataattttattgtatctacttatttacctttagcataattgttttcatgtaatatccagaacatgaaatgtgatcatgaaatctgggaagaaggaaagaagttaggagaccaacattctaccacttagtagccctatgactatagcaacccttctgaacctcagttttctgatctgcaaataagagcattggacttgatgaagtgttttcagttgatctcttgtgaaatcagatgcttttccaaggattccagaaacatttgatttcaaatgcttttttaaagtgtgatgaaaataactcatgcacttaaatgcattatgtaccaaaatttgcctcatcaggagagcctcgtttttcttgacccaaggttacaattacaccttataagtttggacaaaaggttacaaatttgatttagcagtataagcaaa

SEQ ID NO: 57785 - DNA, 478 bp, Homo sapiens
gcatatactggaaataataccttcaatattgaaaaaaatactatttaggaaagaggacagaagaaaatctgccaatattttgacagtggttgcctttgtattaagaatataattaagaatataaaaggattccctgccttttaacatttttctctgctttccaacatgaatattatacctagtaatcagaaaaaaaacagaggcaatcactcttatcctttacatttctctcctgttgggacctcagattcctcagtagaaaattaaactggatgccagcctgggcaatatgatgtcaccctgtctttacaaaaaatgcacagattagccaggtgtggtggtgtgcacctgtagtcccagctacttgggaggctgaggttggagggctgcttgaacccaagagatcaaggctgcagtgagctgtgatctcgccagtgcactccagcctgggtaacagagcaagaacctgtctcaaaaa

SEQ ID NO: 57786 - DNA, 355 bp, Homo sapiens
gctcttatgtaagtgagaaatgttctgaaaaaagaaaaaagagaaatattttaaaatgaaaaatttgagcttttccgtaaaaaaatttttaatgaattcccagcactttgggaggcctaggttggaggattgcttgaggctagttcaagaccagcctggaaaacatagcaagacctcatctctaattaaagtaaacaattaaaaaaaacttagcctggtatgatggtatatgcctgtaatctcagctactcaggaggctgaggtgggaggattgtggaagcccaggagtttgaggctgccgtgagctatgatcaggtctctgcactccagcctgggcaacaaagcaagaccccat

SEQ ID NO: 57787 - DNA, 271 bp, Homo sapiens
ctcacagggagtcccacggccgtccgattcctagaggcagaaagtcgaatggtgggggtgccaggggttggggaggggctggggagttggtttactggggacagagtttcagtttagggaatgggaagttctggagatggatgatggtgatggacaccaagcagctcttcatgccgtggaactaactgtgcacttaggaatggggaaaatggtacatttcctgttacatgtattttagcacaatacaaaattattaaaaaataaaaagatg

SEQ ID NO: 57788 - DNA, 537 bp, Homo sapiens
tgctgggattacaggcgtgagccactgcgcatggcctagaatctgtattttagatactcagtaaacaaaagatagcaaaattcaacaattcgttgtgtaatgacagatcttacacgaaattacagaattctttacaaccctaggacaagtttaattaaagggaagaaactaaaaagtaagaaacagctacagctgtttagcccggaaatatgcatttgtttttctagccgataaatagatcagaacttaagaaattcactgcctctcagtttacctcaaattttacaactaagggccacaggtattatttgttagtctgacaagtaaaaaatgatgttttcttttctcaaaaatgtgaaaaatttaccaccaccgtgcccggcctgtctctttcttttctctgtctctctctctccctcttccccctgctcctagtctctctctctgtctccctccctctcaatctctctctgcctatatccctctatgtctctgcctccctctctgcctctgtattcatctctgcctctgtctctc

SEQ ID NO: 57789 - DNA, 472 bp, Homo sapiens
ctctgatgtttcaaatattttggttagatttgttttatgggaatctaattacacattaggtatttggagtgtaatgtatacattttttgcataagtgaatgaagagatggcaggagggctaaagttgagaatccaggaaatggaaaaacaccagaagcctgcatgactggacaacatgagtatttttgttaactatgcttctgtatgtagatatctgaactaatgaactgagaatacatccttcaagcagaagtgaatgatacattttaatgaaattgatagtttttaagttagaggacaaaatgaagaacaggagaactattgtagtattatagtataaatggttcttgggtgatttcttcagggtacaccatagcgttctaccatgggctttgacatatatccttctggggtcctatttggtcctttcgtctgacatcacattttttggcttcagttaagaggatcacat

SEQ ID NO: 57790 - DNA, 123 bp, Homo sapiens
ttgcacggtagcttgcaaatcactgaggaaatccagaaaatgttagaaaccatagaaccagagggttcctcagcagtgggcggaaggctgaggctttgaggtatggatcatggaaatgagttg

SEQ ID NO: 57791 - DNA, 754 bp, Homo sapiens
tatataggcctctcaaagtgttgggattacaggcgttagccactcatccgcccacgtcggcctctcaaagtgttgggattacaggcgtgagccaccgcgcccggcctagtgaggtaaatgatgttattgtcagcactatagagtggcagggtggagtcttaccctgttgtgaaacacctccctccctctctaggtgttctccccaactgcctgctagggagggtactcccctcaggtagaattaagagggctgagggtcaggggccatgggccaaggaggtcagtcagatctccttggatctggaggccctggctttcagccagaggcagggggagaaagatgatgtctcatgatgccagcgcttcctcttcactggcgtctgacccaggagcagtccagaatcagcttctctgacctcactccaactcacgtgtctttgacactttaagggacttcctgttttagggtcttctggctgggtgtcattgaatgggcagtgattctctaactttagactgatgttccccagcctttgtttggggactcggaggcagagtagacagttacccttacccctgggttggggagggtcatattcctggtatccccaggaggtcaacaggggcttcatttttctgagggactagagggtcttgtggagctcctgggacagagatctagatccagagagaacattcgtccttccgatctcagctcagctctgagagccctcccagagagcagctcccgagg

SEQ ID NO: 57792 - DNA, 1105 bp, Homo sapiens
  misc_feature (686)..(686): n is a, c, g, or t
ggtctaccagtatgcaggttgggatactgaaaatttccagatgagctcttctttcctacaagttttcataattagggaatgccagggtttagggtaggggttaatctgttggggggtgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgccccccccccctcttttttttaagaatggcctgatcatggctatctcagccacattgttggcaatttaatttatttacttcctttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccanggccttatcataaaactctggatttagagtattcatttgaaggcaactcccccttccccaagtttccttggagctgtataagctgggttctaagcttcaccatgcaatcagaaatttatctctaagtacaggcgtgtgccgtgtctcaccaagacccgctggggactctcaggtcccatttcaggtacctggggtataccttgaaccctaaaagtgatggacgaagtaaaaacgggccagcacacaggcgggactactaaaacgaggggaaggggcggaaacaaaaggctccccccaagatatgggtccccaaatatcaggacaactccacagctggaatggaagcgccgcatggggaaactaggagaagcctcggaatggtaaaaacagcaacgggagtacacccccacgaaaaagta

SEQ ID NO: 57793 - DNA, 625 bp, Homo sapiens
ccgaaaaatgagctatgggactttctgtcccttgccctgcccccacctgaagagagccatgtgtttctaggtcttccacgtgctgccctctcccctggatggagcccagagctatgtgtcctcctgtaggtgccatgaggggcagccgcagagacccggcctccagcagcctctcacctgaccacctggcacagctgcaaccaggggcgggtttcctcttttgctccgcccctgccctgagtgggtcctttccacccagacctcaccacagggtcacttggcaactgctggctcctggctttgccaccagttcaggcccacgcacaggcacctgctctgtgtggacccaggagaggggtagcttgggtgggcatcgcttgggaagattcaggaaagtctgtgggtgaagtagccagcgcgcacacacacacacacacacacacactcactcaggcctcctgcaatggctccatgctggaccagcaacagctccacgccggctggacttcctcttacttgttttgtccccatgtgcacaggttcaggaggaaatgggctcagccttcccggttcttccaggaggctccactggctggggggctttgcagatgtttgggaggaccac

SEQ ID NO: 57794 - DNA, 500 bp, Homo sapiens
attttccatcagcatctcacactatgaaaagtagaacttatatttttgctaaaaactcatgttcgtttactcaaaccagatgatgaggataggcctgggcttgttgctgtcacccatttcacttcccgcttttctgaccttcgcaccatccctgccgtcaggtcctttagaccaggagctcattgcttcatctttgcttggctcactacagtgtcactaaacttccttgcctctgccctggcgttatttacttcttttctcacacagtcacagggaggtttctataatctacatataatcttgtcattgttttgcttgcaatcctttcatgattttcagaataaatgacaggtgccccattgtggtgtttaagtttgtgttcatacaacccttgttgaaccctgcaggtgcacctcccggctttggtttcactctttacccacagctgaccacctcactggtgttctactgaccggtcttctccatcccttccctaactt

SEQ ID NO: 57795 - DNA, 441 bp, Homo sapiens
aaagaagacaagtctattcttgtcctacatttttgtataatccctcaccactcaaaatgaatagcccccaattatttagctcctcaaagtatcttagactcaaacttatttttaacacattttgctaaaggttcatgataattgtacagcaaattacttaaaattgtatattagacatccctgggcttaaaagagctcgactcattcttgtcaccagtgttaatctcccaccaatatccggggctgttctctctctgaatctttatccccctttgtgtagctcactcatcttcaacatcctggtaaatgtcttgggcaaagcatttttattacctatgagcattatccccgcagcctcatctttatgacctagtgctggtgttcctgtcacagacaccaagttctccctgagaggaattgtatgattggctcttaaggaaa

SEQ ID NO: 57796 - DNA, 272 bp, Homo sapiens
aatcctcctccaacccggttccatgacacctaatggccattccttgattttaaggccttgtctcccagagtgtgcaatagcaacatcagccatttctatcttcatattaacaacaaagctcagtctctcaatcactcactatatgccagctactcttccatgaattttacagctataagagccagcaccgtgtctgctgacttggccaacctactgaggagaattgccaccattgtgcctcgaagagaggccagcccttagcctggacaaag

SEQ ID NO: 57797 - DNA, 280 bp, Homo sapiens
  misc_feature (40)..(40): n is a, c, g, or t
  misc_feature (95)..(95): n is a, c, g, or t
  misc_feature (103)..(103): n is a, c, g, or t
ctcgtaatgccagcattttgggaggcttgaggcgggaggntcccttgagccgaggagttcgagatcagcctatgcaacacagtgagacccctatntctatttnatttaaaaaaaaaaaaaaaagggggtcacgtttactgccaccatcccaggcagaaagatgaagcctagagcctctcactgcttcctagtgggtcttgggttgtaatttgctgtcttgggtatattttttggcagaaagcatctggcatcaggcaccggttctcaaagtcgggccccc

SEQ ID NO: 57798 - DNA, 843 bp, Homo sapiens
tcggtacccgccactctgtgggccaggctcggtggctcatccctacaatcccagtactttggacagctaaggtgggaggactgcttgagcccaggagtttgagacctgccttggcctcccaaagtgttgggactacaggcgtgagccacagcacctggccttatgccaacaaaactcttatgagtaaaaccattattaaggtctgtagtatcagagacctcaaaatgtgaatatacagcatatgatttactacatcatttaataaatgtctgtttatttcagtaatgggagaatatcacttttactttgataatataagggtagatcaaaagtttcagatatgtatgagaaaagccagattatatttttaaatgctatatgtactctacatctctttcataatggaataggagaaagatgtcctgaaaaaactggcaacagtggatagcctcagagttctaaattaatcaaaatatctcaggtttctttcattcacataatctttcttctgtgcttatgatctcagtggggtttcttggattctgagataatgtgcccctttgctatctagaatgtgtatgccatagaaatactggatagaggtaggatcagcagctaatctatgagaaattttgtatgattagacacaaaaaattgaatgcttatcctaccgtccagtaaaaaatatttttcggtgtccccaaaaatagcaatttattaatggaaaaatataattttatcactaccactttttaatgctacaagtttctccaggagcaaaggataagaagaaaaagagaaattttaataagttattattattattatttttgagacagtctc

SEQ ID NO: 57799 - DNA, 664 bp, Homo sapiens
ggatgcttagtcaaagactgtaaattgtcttcaagctgagagagaccatgaagagagaggagtggccacctaactaaccttcccagtttttgggagccaaacctagaccagaatgtaggtctaagtgactcccaatccagagctgtctccattaggccaggctctcaccccagctccaaaccaacttctaaaaacttgtccaagagtcctcctcttctttagaattggtaatcttggcaattaaattcagcgtagaaacactctcctgaacataatcagcatgctggttcttccttttctgttgccttgctcttcctaacagctcctcctttcgtctttgcaggctgcttctctgtcacaggaactcagggctcagtgctgtacttcatctccaaagtgtccctaaagcgcccatctgatcccatggctaactactccccaaattttctcctggactgaccttactgaatttagatttgtacatccaatacctgcttaacatatccactttgatgctcagtgggcacctcacacttgatctgtcaaacactgaatttctgtctctgttatgcacatacccaaactttccccaccatgtatttccccatctcaataaactgcaatagctcaagccaaaagcctaagattcagacctgaattcttt

SEQ ID NO: 57800 - DNA, 263 bp, Homo sapiens
caaaaactggaaaaagtttgattctcctaaaccttaaaaaaaagccaaaaactagttttactttgtaatactgtttgacctaaaaatgaactgggtgaaaatacaaacatcagcctgagaccccagtaaccttatgcaggaaatcctcaaattagcctcttcagtcttttacaactgagagcagaataaagaggacagagggaaaaagaagaacaaacacaaagataagaggcaggctcaactattggctgctttataagctc

SEQ ID NO: 57801 - DNA, 328 bp, Homo sapiens
  misc_feature (272)..(272): n is a, c, g, or t
  misc_feature (302)..(302): n is a, c, g, or t
  misc_feature (318)..(318): n is a, c, g, or t
tggaaatgtggtcctggccccggtactgtgtcattcttctgaatgggatcacctgcacccatccctcctaggagaaaatttcaaacagagttagctccttaaaccttctaattaaaatgagaaatccccaggcttccatgactcagcctcagaaaaagattattaggaatttaatagggaaaatatagcagctcagaccatctgtgacccagtgctctgtgagaatttaaagaaaactggagggaggcagcccacactccaatgacacacgnactatggctgcggtcccaacttagcccttngctgcgctgttggaanccgacctttt

SEQ ID NO: 57802 - DNA, 5778 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgttttatgttgtacaatgtagatggcctcttactaatgtaaaatgatttgtagtggaaacatttatatttttataataaacataatgaaaatattttttacagattggaatacaga

SEQ ID NO: 57803 - DNA, 2683 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttcttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacag

SEQ ID NO: 57804 - DNA, 5815 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaatacaga

SEQ ID NO: 57805 - DNA, 3494 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgctttttttcttttttcttgtctttattccttcttttttgggtttccttggtttccccttttttatcgcttttgtctatgttcgcccttttggtcgcttctgt

SEQ ID NO: 57806 - DNA, 2223 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcagtcctgacttctgaacagctccatgatgcagaagggtttagtctggctggttttaatgtttcctcacaagagtgcacttttctccagcacggagcctgcggtagcaaatgc

SEQ ID NO: 57807 - DNA, 342 bp, Homo sapiens
tgggggggaataaaacaggaatgtatatttaggtcatgttaaataaaatggctggaggaaggagggaagaaattaggaactgcagtacatcatcaccccaggtgtaagagttatttctctcccagtgcagaaaggggagtgtggcccctggctgtacctgagcttcctcttctccatccctgagacatcacagaatcacccgggttctgacctctccacttctagctctcactgacatctggatatcttgatgcactgcctgtttgtaacaacatatacttctttgctgaatgctaataaacttctgggttcaagagggaacccctcagtcactaatgtgca

SEQ ID NO: 57808 - DNA, 288 bp, Homo sapiens
agaagaaaattcttaagcaaagtacttaagtacaaaattgagtgactgaaagatgcttaatctagggaaattaaatgagaaaaatacatggtgtgtgtgttggagggggagctggaattggaatgggctggagtgatgaaaaaaagccaacagatacagtcttctgttttgtaatataggctcaatactaaattatgtaggactagataatctaggtcctaatgtctcctttttgctggcaacctgggggccaattacactagagggttggtagaaaaaagagaatat

SEQ ID NO: 57809 - DNA, 227 bp, Homo sapiens
gataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatct

SEQ ID NO: 57810 - DNA, 164 bp, Homo sapiens
ctggatagacctatgtcataactgatttctgcacattgaaggtacctagattgcctttaaaaggtataaagaaagggttaagtttcttttttttttgtcttttttttcccaaaatgaatcaaaagatctcatttatttagctttagaaagtacaagtgtaagta

SEQ ID NO: 57811 - DNA, 6213 bp, Homo sapiens
gtcgggccgggcacggcgggccggggcctttgtgtgaagcggcggcggcgatggtgctcggggcgccgcagagccggattaactgtgctgataaggaggtaatttcataggagctgctaagatgggcatgaggatcaaactgcaaagcaccaaccaccccaacaacctgctgaaggaactcaacaagtgccggctctcagagaccatgtgcgacgtcaccattgtggtggggagccgctccttcccggcccacaaggctgtgctggcctgtgcagctggctacttccagaacctcttcctgaatactgggcttgatgctgccaggacctatgtggtggacttcatcacccctgccaactttgagaaggttctgagctttgtctacacttcagaactcttcacagacctgatcaatgttggggtcatctacgaggtagctgagcgtctgggtatggaggacctcctccaggcctgtcactctacctttcctgatctggagagcactgccagggccaagcccctgaccagcaccagtgagagccactctggtaccctgagttgtccttcggcagaacctgcccatccccttggagaactccgaggtggtggggactaccttggtgctgatagaaactatgtgttgcccagtgatgctggagggagctataaagaggaagagaagaatgttgccagtgacgctaaccatagcctgcatctgccgcaaccgcccccaccaccgccaaagacagaagaccatgacacccctgctcccttcacgtccattcctagcatgatgacccagccactcctaggcactgtcagcacgggcatccagaccagcacgagctcctgccagccatacaaagttcaaagcaatggagacttcagtaaaaacagcttcctcacccctgacaatgcagtagacattaccactgggaccaactcctgtctgagcaatagtgagcactccaaagatcctggctttgggcagatggatgagctccagctcgaggacctgggggatgatgacttgcagtttgaagaccctgctgaggatataggcacaactgaggaggtgattgagctgagtgatgacagtgaggatgagttggcttttggagagaatgacaatcgggagaataaggccatgccctgccaggtgtgcaagaaagttctagagcccaacattcaactgatccggcagcatgctcgggaccatgtggacctgctgacgggcaactgcaaggtctgcgagacccacttccaggaccgaaactcccgggtaactcatgtcctgtcccacattggtattttccttttctcctgcgacatgtgtgaaactaagttctttacccagtggcagctgacccttcaccgacgggatggaatatttgagaacaacatcattgtccaccccaacgatcccctgccagggaagctgggtctcttttcaggggcagcctccccagagctgaaatgcgctgcctgtgggaaagtattggccaaagatttccatgtggtccggggccacatccttgaccatctaaacttgaagggccaggcctgcagtgtctgcgaccagcgtcaccttaacctctgcagcctcatgtggcacacgctgtcccatctcggcatctcagtcttctcctgttctgtctgtgcgaacagctttgtggactggcatcttctagagaagcacatggctgtgcaccaaagtctggaagacgccctcttccactgccgcttgtgcagccagagcttcaagtcagaggctgcctatcgctaccacgtcagccagcacaaatgcaacagtggccttgatgcacggcctggttttgggctgcagcacccagctctccagaagcggaagctgccagcagaggagtttctgggtgaagagctggcgctgcagggccaacctgggaacagcaagtatagctgcaaggtctgtggcaaaagatttgcccacacaagcgaattcaactaccaccggcggatccacacgggggagaagccataccaatgtaaggtgtgccacaagttctttcgaggccgctcgaccatcaagtgccacctaaagacacactcgggggccctcatgtaccgctgcacagtctgtgggcactacagttccacccttaacctcatgagcaaacatgttggtgtgcacaaaggcagcctcccccctgacttcaccatcgagcagaccttcatgtacatcatccattccaaagaggcggataagaacccggacagttgactgggtcccggcagagccacggggagctcccaagcagcagccaggatgctgatatctaagaggtgttggtccctccccagctgaagttataattttgccttggtaggaattctgttctgtgttgtgtttaaagaagaaaagaagaagaaatagcacataagctgttactgttgttgagaagcaacagccctatcacatttacctccatacctgttcttgcccatgcagggctatgtttttcattcttttgaggctggttttgggatctagtcaagcagttggtgtccactagacccccttccccagcctctctagttttagtttactgataggttttatgctgctaagaatccaaccaacagcctcacttaacagaggaggtaaagggaggttttcactgtgggtgttactgcaggcctccaactgggatgaccagcaatgagaaagattttgggaatgtgatcattcagaaaagacaggtcagcagggcagtcccctcaggttccagccctcagcagggacaagacatcagggatgttggtgtctgcttatctacagccctaatctgctgattgaacagtgaaaatcttttggcagctagatccatactaggcacagagctttctatttaggtcagaaagctttgggatgaacccctgccagccagaaggggtgtcctgcagtgccaccagaagtggcagcctggatggacaggagaggtttctcttttctcctcatttccaaagaaacaggattttatggagtgatggcccgggacgtccggccttctgtggggcagagaggatagggaaccactttgatatagtcatctgttttggccacttctgttggccatgagtgtcttggtggagaggtggggatgtatctgacagcagcagccttgccttaatttatatctggtctcccgtccagaagtgtttggcccgtggtgtagatgagctgactccatgaagtggtggagtggcagaccgcgagcccttcaggattaaagggacctgagtaactggtggtgtgtagcagggtgtgcgttctgactgtctgtcctagtcgggtaacctgtttactttgtgctaacagtgccggagctttgtcagctcacctttgacctgctggaatttatcctgatctgtcgttgccatcacctccagggggcgctattggatggcagctggttcaggccctccgtgggtggctgcagagtgtgccggcacagcccacgcagctggttagctccactcttacttggttttctaaggggctttgcccaaagaagtcttgagggatagggccctcgatcttgcatacttgtgaggtgccacctcagtagctcatactacctcaccctgctcaggtgagctctgggagtccctggcctcagccctggcactgcccctggtgggattcagcaacaccccgggctgtttcacaagcaagtggttttcattaactcacaaagcctttttggacattaatatttatttatttttgtttttgtatacacattacccagcatctcttttgtataagagactttaggaaaatgagtttctccccagcaagtagccatattccagagaacagccttgaccagagatgtggagaaccaggggtataactaagggaagacatgtcaagcccttaagcaaattcttcttctccagattgtctctagcataataaacccagggaacactttaggccatgggtgtatgttctataaagttcgggacagttaaattccaggcctttcatcccccttccttcctgtgatggagtagattggggacagggttgaggggaacaagtgacatgaatgacctatttgcacagtttggaagcctcctgtctttatttatattgagatgtcagacaaaccaaagctccatccttgttggacctgctgcttctccccagccctgaactgataaagcctcagagttggagtgcctggctctctggtggggtgaccattagatgaagggacttgtacagtggccagtttaaaggtccacctttgaccatctaaacccaccttgttcagtgtcctctgaggacatcctcatcaggaaagcagtgttgagactcttcattgctgactggcttctccctttcttactcacactgaccattagaatttaagaaggaaatgtgtaacagactacagtcaagtgtctgctacattttcaagcatgagcaatccctcccagactgttggtgaggactgatttttgaaatgctggtgtgagagaggtggtaattacaggaaccagccgagtggctgagagcagataaatgtgctggagaaacctttttccttaacagagggcatcatggatgctgggtggtctgtgtacttaacctgaaactgtgaagttttccctttttgccagtaaaccaaaaagcagatccttgaaacttggcccttgaaacacgaaacagaaaactgcatcccctgatcccccgggggctgatcagattgatcagggtggctcagttggtcccagtcagatacgtcataggatcagtagctcatgagatttgttgaccaaaccctctccctgttggtgacccctgtattcacacctgaacttcccgtttccccccaccccaccaaagtcatgtctgcttcctctgcctccagctcaccctcttctgaatggttttgcttgaaacactatattgtggcagagggcaccctgggatacctggtagaaggtattcattttattttgcatttttaattgttttgactttctgttcatttgattttgttgctccctctctcctggaacctagtttactactctcttctgtgttactctgaagttctgtttaagccttgaacatcctcttctcccattttcttggtatgtactcaggaccagctacatcatttgtggagccctcttattcataaattattaaaaatttcaaggtggtggtcatagagcattaaaccaaatatgaggccattcccaacttgttttccgaggggaaaatggtaatacttgtgtggcacccggggttaaacagcagaggctccatgtggccagaggcagagattagtatcctggcactccagtgacccactgggtgactcactgatgccacagcacccgctaggaagctctgctgaaccttagtatttggtcctaaattttatgactccatggagttcccgtagtccatggctagttaggaagaaaggaggtgggataagggtcaggcccaggtgacccctaagaaccaggagatgggtaaaagtttttttttatattctgcttttctgatctgtgagtacctgtttgtctccaggccaaacctttgggcttaaatatctttttcctagacaggtttttgctagtgttgaattttcttcttcctctggcctccttctgtgcccctttccccaagcccaagactgcttaacttccaaagcaaattctagatagacactgtatttattggtatgggagtgggctctatggggtggtctgcacccatctgggactcttttccctaaatcctgcaccaaatgagtcaggaggcagggtgcacagcattagtttcaatgtggttatgcatcataagcttaacatcagaatgaaaatgaaactcgattttgatgtttctttaaaacccttcccctgtccaatccactcgccgcccccaccttgaatagctaaagtctcttatgaaacagagaagagttgttgacgtctaactccttccattaaattaataagtactgacctcctaatatttaagtgtttactatctattgctgtaaagttttgtatattttgtaaacttttttccccaaatagtagatgtctaaaatcattgtacatctgattcttttatattccattgttcagcacaaagtgtggtttttatttagaataaaaaaagaaatttgaaatgagaaatct

SEQ ID NO: 57812 - DNA, 2409 bp, Homo sapiens
gtcgggccgggcacggcgggccggggcctttgtgtgaagcggcggcggcgatggtgctcggggcgccgcagagccggattaactgtgctgataaggaggtaatttcataggagctgctaagatgggcatgaggatcaaactgcaaagcaccaaccaccccaacaacctgctgaaggaactcaacaagtgccggctctcagagaccatgtgcgacgtcaccattgtggtggggagccgctccttcccggcccacaaggctgtgctggcctgtgcagctggctacttccagaacctcttcctgaatactgggcttgatgctgccaggacctatgtggtggacttcatcacccctgccaactttgagaaggttctgagctttgtctacacttcagaactcttcacagacctgatcaatgttggggtcatctacgaggtagctgagcgtctgggtatggaggacctcctccaggcctgtcactctacctttcctgatctggagagcactgccagggccaagcccctgaccagcaccagtgagagccactctggtaccctgagttgtccttcggcagaacctgcccatccccttggagaactccgaggtggtggggactaccttggtgctgatagaaactatgtgttgcccagtgatgctggagggagctataaagaggaagagaagaatgttgccagtgacgctaaccatagcctgcatctgccgcaaccgcccccaccaccgccaaagacagaagaccatgacacccctgctcccttcacgtccattcctagcatgatgacccagccactcctaggcactgtcagcacgggcatccagaccagcacgagctcctgccagccatacaaagttcaaagcaatggagacttcagtaaaaacagcttcctcacccctgacaatgcagtagacattaccactgggaccaactcctgtctgagcaatagtgagcactccaaagatcctggctttgggcagatggatgagctccagctcgaggacctgggggatgatgacttgcagtttgaagaccctgctgaggatataggcacaactgaggaggtgattgagctgagtgatgacagtgaggatgagttggcttttggagagaatgacaatcgggagaataaggccatgccctgccaggtgtgcaagaaagttctagagcccaacattcaactgatccggcagcatgctcgggaccatgtggacctgctgacgggcaactgcaaggtctgcgagacccacttccaggaccgaaactcccgggtaactcatgtcctgtcccacattggtattttccttttctcctgcgacatgtgtgaaactaagttctttacccagtggcagctgacccttcaccgacgggatggaatatttgagaacaacatcattgtccaccccaacgatcccctgccagggaagctgggtctcttttcaggggcagcctccccagagctgaaatgcgctgcctgtgggaaagtattggccaaagatttccatgtggtccggggccacatccttgaccatctaaacttgaagggccaggcctgcagtgtctgcgaccagcgtcaccttaacctctgcagcctcatgtggcacacgctgtcccatctcggcatctcagtcttctcctgttctgtctgtgcgaacagctttgtggactggcatcttctagagaagcacatggctgtgcaccaaagtctggaagacgccctcttccactgccgcttgtgcagccagagcttcaagtcagaggctgcctatcgctaccacgtcagccagcacaaatgcaacagtggccttgatgcacggcctggttttgggctgcagcacccagctctccagaagcggaagctgccagcagaggagtttctgggtgaagagctggcgctgcagggccaacctgggaacagcaagtatagctgcaaggtctgtggcaaaagatttgcccacacaagcgaattcaactaccaccggcggatccacacgggggagaagccataccaatgtaaggtgtgccacaagttctttcgaggccgctcgaccatcaagtgccacctaaagacacactcgggggccctcatgtaccgctgcacagtctgtgggcactacagttccacccttaacctcatgagcaaacatgttggtgtgcacaaaggcagcctcccccctgacttcaccatcgagcagaccttcatgtacatcatccattccaaagaggcggataagaacccggacagttgactgggtcccggcagagccacggggagctcccaagcagcagccaggatgctgatatctaagaggcctcagaaaagcacctaggagcctttggtcaaaatgcaatacaaatctatcattggtgactgactgcatggagcatgtgctgaccg

SEQ ID NO: 57813 - DNA, 662 bp, Homo sapiens
  misc_feature (11)..(11): n is a, c, g, or t
cccgggctgcnggaattcggcacgaggaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaaaaaaaaaaaaaaaaaaaaaaaaaaaaaatttgggggggggtgggccctcggaaaaaccttcaaaacaatcgacagggcccgcgggcccaaacgggtaagtgcaacaaggggccacaaccggtcccagagaaaacccgggccaacacaagcgcggggatctccaccaaaa

SEQ ID NO: 57814 - DNA, 474 bp, Homo sapiens
gcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggtaagaaatctccctgtat

SEQ ID NO: 57815 - DNA, 285 bp, Homo sapiens
ggtcattcagttgaatatttagtaacaagtttgtttgctgtttaaatattgtctgtcacttgttttttttaggttacatttcggacaagaatctatcattgtaatattaacagtcaaggtgttatttgcttggacatattgaaagataattggagtccagcactaaccatttctaaagtcctcctttctatctgctcacttcttacagactgtaatcctggtaaggttcataattctttaccttgttttattcttccttacctgaaaaatacttgtttccaaaag

SEQ ID NO: 57816 - DNA, 1671 bp, Homo sapiens
gcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaaaaaaaaaaaaaaaaaaaaaaaaaaaaaatttgggggggggtgggccctcggaaaaaccttcaaaacaatcgacagggcccgcgggcccaaacgggtaagtgcaacaaggggccacaaccggtcccagagaaaacccgggccaacacaagcgcggggatctccaccaaaa

SEQ ID NO: 57817 - DNA, 1276 bp, Homo sapiens
cgccacggctggcaggtcactcgggcccgaggggcctcgtggggagcggccatgttggcttcgtcactgaggactccgggcgggtcgggtgttgagcgaggcctcggaccttcggcctgtcgggggcgccctgccgggaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57818 - DNA, 1230 bp, Homo sapiens
gagcggagtctatccccagtgtgagctagagagcggaccatgaaggaagtgggcagaccccgggaagttagaggacgcccggggaaaagcagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57819 - DNA, 1448 bp, Homo sapiens
gcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57820 - DNA, 912 bp, Homo sapiens
  misc_feature (15)..(15): n is a, c, g, or t
  misc_feature (19)..(19): n is a, c, g, or t
  misc_feature (23)..(23): n is a, c, g, or t
gcaggctggtacccncggngtanggggatagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57821 - DNA, 493 bp, Homo sapiens
  misc_feature (11)..(11): n is a, c, g, or t
cccgggctgcnggaattcggcacgaggaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57822 - DNA, 1502 bp, Homo sapiens
gcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57823 - DNA, 1481 bp, Homo sapiens
caaaagccttaatgggcctgcagactttgaaaagcgagtggagggcggtgggcggccgcgtgcgcccctggtcaatgccctcctgacagcacccgagttccttatttacactggctgcatggtttgtgtgtttctgttttgtttctctccccctgcaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57824 - DNA, 1409 bp, Homo sapiens
gcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57825 - DNA, 1828 bp, Homo sapiens
gcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaacactgctgtgttcatttacttttcttttgccttttggttgccattcgcagattcttctgaaatcgataggtatctgcttctaaaacaagctaaaaataatgcatatttagtaggtattagttagttacctatattaggatctgtactttacacagctgtagatgaggtatcctagaaaaggttaaataatctaccccatttaggcttcaaagacgaaccctactgcatctttttaaaagcattttctgacttgcagatgctgtagtagcaagtacatgagaaatgggttccgtcatggataaattggtaccctgccttagggggca

SEQ ID NO: 57826 - DNA, 1351 bp, Homo sapiens
gcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 57827 - DNA, 1205 bp, Homo sapiens
cgcgcggccggtcggaacttcggagggcccgggcggtcgctgcgcggtggcggagcgtctagtggccgccgcaaccggtggctccgggccgccgttgtgaagtgagcgggcctctcccgcgccgcggcccgccgggcaccgccgctggaccccgcgccgacccggcagcgccccgacctgccgctcgggaggtccgcgaccgtttcgatttctgttcctaaagtccgattttggacgctgaaaaggaggctgtggaggggcgagcggcgtcctgggaagcaaggcctgctctgtgcggagcagaaacgccttgtgcgaacagaaataaattcccgcggaaaggatgaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtgtggcaaaatgggagttcgcgtcctggcgaattgaagctgggacgggtgggttgtgaagaacacgaattctttggggaaccttattggggttgacccaccgggttttcactttactggttcacagattgggcactttttaccgaaatgaagggatggggggaggcatagagaaaagagaattggagtgctgggcccccaacaagaaacggcggtggagctaacacacacaaatggtgtgtggggttcgccagaaaactgaggacgacccgatggacgccgaaggggcacgaggacgaacagaacaagcacaggcaggaagtaagcgagggagcaccaccgtgagacgacggagctgcacacaggtcgcgcggcgcaagacgaggcaggcacaggagagcagaaaaacaatcaggtctccgagcaccggcaggaacagtgagcaacgctagacgagcgagagacaacaaagagaaag

SEQ ID NO: 57828 - DNA, 3533 bp, Homo sapiens
gcacagggggaaaccccgagccatcctcggggggtgatgagaggcgccgccgccggcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57829 - DNA, 3407 bp, Homo sapiens
gcacagggggaaaccccgagccatcctcggggggtgatgagaggcgccgccgccggcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaagcaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57830 - DNA, 3293 bp, Homo sapiens
ggcggcggcacgcgcgcatctgggatccggccgcttctccgctcatgccatcttgtccgagccagtcacgtgcgggcgacagccgcgcgcttcgccgggccggtactccaggtccgacccgcgaacccctctgggatccccgccgctctgtctacaacccgagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaagcaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57831 - DNA, 3830 bp, Homo sapiens
cgcgcggccggtcggaacttcggagggcccgggcggtcgctgcgcggtggcggagcgtctagtggccgccgcaaccggtggctccgggccgccgttgtgaagtgagcgggcctctcccgcgccgcggcccgccgggcaccgccgctggaccccgcgccgacccggcagcgccccgacctgccgctcgggaggtccgcgaccgtttcgatttctgttcctaaagtccgattttggacgctgaaaaggaggctgtggaggggcgagcggcgtcctgggaagcaaggcctgctctgtgcggagcagaaacgccttgtgcgaacagaaataaattcccgcggaaaggatgaaggtggacttttaaatattctccactgaagcaaatgctgcaacaatttgcatttccttcaccaatgtcgtcttgtgccttttcttgttcctactgtaaaggagatgggttagatgttaaacgaagtctcactgtgttgtccaggctggtctcaagctcctgggctcaagcaatacttccacctcagcctcccaaaatgctgggattacagatggagtcttgctcttgttgcccaggctggagtgcaatggcacgatcatggctcactgcaacctctgcctcctgggttcaagcaattctcctgcctcagcctcccaagtagctgggattatgggcatgcaccaccattcctggcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaagcaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57832 - DNA, 4572 bp, Homo sapiens
gcacagggggaaaccccgagccatcctcggggggtgatgagaggcgccgccgccggcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgattatgtggctctagggttttgaatgtatagtcacactttgatcattttaaaatcgattcttaggagttcctttgtttactacctctgttgataattgagcttacagccatgtatgaggttttttgtatgatgccatttttaagctacataaacactaaaattatgacagaatttggagggggggaaactgtttgctttcttaaaaacattatatggggcacttacaccagttccttaactgacctgatctgagaactctactgttactgttctccatcttgacccagccgaggctgcctgtgttaagtaacatcaccaagactgttagtatttctgtttaattgccctcttcctattcattctcagagggacttcagtgacttttattttgtgtttacttttctctagagttgtttgtctacctctgtttcatttctaaggtctttactttgggtgaaaatcagtaagtgttccatggacccacagcgaagcccatttgtccttctttccaggtgtctccagtgtagaagcacaccacagaaaacatgttttggagggtaacgcagagcatggagtttctgttagcagtgtcctcagtggcaggataaatactgagatgtggttaaggattctggaaacctctttgcctagccacacttagacttttttcagctaatcctttaaattgaatataatctttagtccgaggattcccatttaaacaactcagtattcttttaagtgtgtcttttagcccagctcaagttaacatgaaactccaggtgaattttcacttactattccattgctagctattatagaataatagcgtttgctgcactattctagtcatgaggagtgaggaaaaacatacataggttgtctcccttaaatggtttgctttgctgaattttttttatcctaatcacctgcaaatttataacccaatcattcttcctcaagatttgaaaatgttttaatcctgcaaactgggtgaattctaaacagctctacaaatataaggaaatattacagcaaa

SEQ ID NO: 57833 - DNA, 2412 bp, Homo sapiens
cgcgcggccggtcggaacttcggagggcccgggcggtcgctgcgcggtggcggagcgtctagtggccgccgcaaccggtggctccgggccgccgttgtgaagtgagcgggcctctcccgcgccgcggcccgccgggcaccgccgctggaccccgcgccgacccggcagcgccccgacctgccgctcgggaggtccgcgaccgtttcgatttctgttcctaaagtccgattttggacgctgaaaaggaggctgtggaggggcgagcggcgtcctgggaagcaaggcctgctctgtgcggagcagaaacgccttgtgcgaacagaaataaattcccgcggaaaggatgaaggtggacttttaaatattctccactgaagcaaatgctgcaacaatttgcatttccttcaccaatgtcgtcttgtgccttttcttgttcctactgtaaaggagatgggttagatgttaaacgaagtctcactgtgttgtccaggctggtctcaagctcctgggctcaagcaatacttccacctcagcctcccaaaatgctgggattacagatggagtcttgctcttgttgcccaggctggagtgcaatggcacgatcatggctcactgcaacctctgcctcctgggttcaagcaattctcctgcctcagcctcccaagtagctgggattatgggcatgcaccaccattcctggcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57834 - DNA, 4215 bp, Homo sapiens
gcacagggggaaaccccgagccatcctcggggggtgatgagaggcgccgccgccggcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgattatgtggctctagggttttgaatgtatagtcacactttgatcattttaaaatcgattcttaggagttcctttgtttactacctctgttgataattgagcttacagccatgtatgaggttttttgtatgatgccatttttaagctacataaacactaaaattatgacagaatttggagggggggaaactgtttgctttcttaaaaacattatatggggcacttacaccagttccttaactgacctgatctgagaactctactgttactgttctccatcttgacccagccgaggctgcctgtgttaagtaacatcaccaagactgttagtatttctgtttaattgccctcttcctattcattctcagagggacttcagtgacttttattttgtgtttacttttctctagagttgtttgtctacctctgtttcatttctaaggtctttactttgggtgaaaatcagtaagtgttccatggacccacagcgaagcccatttgtccttctacctacgcctaatctactccacgtcaatcacactactccccattttttaccacggtaaaattaaatggccggtttgaccttccaaacccccccccattcttccccacactcatcgcctttcccacgttactcttacttatctccccttttatactaatattcttataaaaaaaaaa

SEQ ID NO: 57835 - DNA, 548 bp, Homo sapiens
ggaactgtgttctggtccttagagaggttaaggttctggcctagagcaaaataacttggaaatttcacagcattctcctatggtcatttctacagggagccacatgccatagatgtgacagttctaggttttatcaaaagttactaacttttctcatgttttggacagtgaagagggtatgtaattatttctcctccctaggaaacattcacgtaaacaactcttcacacagcaggttcacctctgtcagggtagaaaggtcttctgtcagagaccagaagagaactatacaaaagtgaactgtgaggttactctatgactgaaaggccgtggctatgtggcattaacctagcgaccgtgataaagctacacatctgctgggctttctgttcttcccagccagtgtgatatgctgcaagtaacagataagagacctttcagccctcagggtggcaagtcaggatctggggaagccagagcgtctggaccagactcctccagccacaagaaggctcagctgtctacacagtggtccaaacaaatataat

SEQ ID NO: 57836 - DNA, 3594 bp, Homo sapiens
cgcgcggccggtcggaacttcggagggcccgggcggtcgctgcgcggtggcggagcgtctagtggccgccgcaaccggtggctccgggccgccgttgtgaagtgagcgggcctctcccgcgccgcggcccgccgggcaccgccgctggaccccgcgccgacccggcagcgccccgacctgccgctcgggaggtccgcgaccgtttcgatttctgttcctaaagtccgattttggacgctgaaaaggaggctgtggaggggcgagcggcgtcctgggaagcaaggcctgctctgtgcggagcagaaacgccttgtgcgaacagaaataaattcccgcggaaaggatgaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaagcaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57837 - DNA, 3510 bp, Homo sapiens
gcacagggggaaaccccgagccatcctcggggggtgatgagaggcgccgccgccggcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57838 - DNA, 2816 bp, Homo sapiens
gcacagggggaaaccccgagccatcctcggggggtgatgagaggcgccgccgccggcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacgctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatga

SEQ ID NO: 57839 - DNA, 4447 bp, Homo sapiens
gcacagggggaaaccccgagccatcctcggggggtgatgagaggcgccgccgccggcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgattatgtggctctagggttttgaatgtatagtcacactttgatcattttaaaatcgattcttaggagttcctttgtttactacctctgttgataattgagcttacagccatgtatgaggttttttgtatgatgccatttttaagctacataaacactaaaattatgacagaatttggagggggggaaactgtttgctttcttaaaaacattatatggggcacttacaccagttccttaactgacctgatctgagaactctactgttactgttctccatcttgacccagccgaggctgcctgtgttaagtaacatcaccaagactgttagtatttctgtttaattgccctcttcctattcattctcagagggacttcagtgacttttattttgtgtttacttttctctagagttgtttgtctacctctgtttcatttctaaggtctttactttgggtgaaaatcagtaagtgttccatggacccacagcgaagcccatttgtccttctttccaggtgtctccagtgtagaagcacaccacagaaaacatgttttggagggtaacgcagagcatggagtttctgttagcagtgtcctcagtggcaggataaatactgagatgtggttaaggattctggaaacctctttgcctagccacacttagacttttttcagctaatcctttaaattgaatataatctttagtccgaggattcccatttaaacaactcagtattcttttaagtgtgtcttttagcccagctcaagttaacatgaaactccaggtgaattttcacttactattccattgctagctattatagaataatagcgtttgctgcactattctagtcatgaggagtgaggaaaaacatacataggttgtctcccttaaatggtttgctttgctgaattttttttatcctaatcacctgcaaatttataacccaatcattcttcctcaagatttgaaaatgttttaatcctgcaaactgggtgaattctaaacagctctacaaatataaggaaatattacagcaaa

SEQ ID NO: 57840 - DNA, 496 bp, Homo sapiens
gatccccgacgaggggcaggcaaacgggcgcagtgcccgcggcggcggcacgcgcgcatctgggatccggccgcttctccgctcatgccatcttgtccgagccagtcacgtgcgggcgacagccgcgcgcttcgccgggccggtactccaggtccgacccgcgaacccctctgggatccccgccgctctgtctacaacccgaggtgaggcgcaggctggatcggggctgggccagggcgggcactgggttcccggggacgcgtctcctcttccgggccgttccgctcggggccacagcgccgtcgggggcccgaggcgccgccgcgtgtcctgcgccacggcctcggggccgtccgcgccgagttgctggctgggggcgtgggtggcccgcggcgccggacccccggcacaccagcccgcggagtccttgcctcccgcgcggccccagccaggagggatggcgctggggcgggagcggggcagccgggcccgggag

SEQ ID NO: 57841 - DNA, 1245 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgctt

SEQ ID NO: 57842 - DNA, 2552 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgcaaaaaaaaaaaactgctgcttattttccactgatcttgtctagtgatcatcttaatttttatctctgaacacatacttggtatctttgagtacctgtagctttcttcatttggcaatgatagtgatgtctgacttgattaactgcctaattcacacatgaagacattgactttgccagtattaacttctctgagatcattttgccttagatactgataactatagttcagtatatataaacaaaaaaatttcatattactaggttaacttttaggtaactggcaggtaccagcagcaagctcctctgtgccttttaaaaacttccatttgc

SEQ ID NO: 57843 - DNA, 2283 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57844 - DNA, 691 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgccttggtgaattcgtttcctgaaagtttatcgcatacttgtactgggttagcttatctttcccttattctgttctcattgctttagccttatgccagcctggaccatcttggaggcagtgtaggatcatggaagaactttgaattagtcttgtgcaaactgtgatacgatcctgaccaaccgctcagaactcatctccactcgtttcacaggcgccactggcagagcatttctttttaacaagagtaaccctgagtacaacgaagtcaagatcggtcatgttactggccgcacatggttcagg

SEQ ID NO: 57845 - DNA, 2222 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57846 - DNA, 2168 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctattttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57847 - DNA, 2168 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57848 - DNA, 2176 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttcaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57849 - DNA, 2165 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagcccctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57850 - DNA, 1782 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactactt

SEQ ID NO: 57851 - DNA, 2519 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgccttggtgaattcgtttcctgaaagtttatcgcatacttgtactgggttaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57852 - DNA, 1797 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgttcagcccaatttatgcctttcccaccattaaatcgatctgttgtttaccaaactattctacatatttacgcctccttatcgatcactatatgaccgagactggctttcaactcgatgatcaaggccgaacgctt

SEQ ID NO: 57853 - DNA, 2580 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgccttggtgaattcgtttcctgaaagtttatcgcatacttgtactgggttagccttatgccagcctggaccatcttggaggcagtgtaggatcatggaagaactttgaattaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57854 - DNA, 2225 bp, Homo sapiens
ggccccactgggctgccgggtgagcccacccgggggtcgcccgggccggcccagctccgccagcttcgggctgcggccttccctccgcttgcagtcgggagggtgggcgtgcccttgcaacccctttcctgtaccttctctgcaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57855 - DNA, 3293 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgccttggtgaattcgtttcctgaaagtttatcgcatacttgtactgggttagccttatgccagcctggaccatcttggaggcagtgtaggatcatggaagaactttgaattagattgcattctgtacttttctgtagttaacagctttgtaacctttgaccagttaataacctttttagccttgacttggatgatctgtgaagtgatggtaacaacctcacagagctgtgacaattttgaaataagtacctagtaacagtgctccctagacattgacttaaagttagtcatcacctctatagttgtagatgcacctggtgatcacagacctactcactctgtgttctcaaaccagactactctcttcttgttttctaattgcccctttatctacttgtatcccactgaaacctcacaattcttttctgaaattatacatgctcagaacgtatacttaacatttatgctaaaccttttttctcacctctctgccagtgctttacatcattcattttctgaaattccactttccattttctttttccacaccagccataagagaagtgacactattctttggccttggctaataggtttacttccttggctcactgctttaaaatcttcttagcttaggcatgcctgtttatttgttcagtgtgtgaactttggatctttttgttcaggatcagctatttcacacatcgagtactacaaagcagagattacataaatacgtatacaaattgttctctatgacaccccccaagtaggtgctaacatgattattataatgcatttgttatccttttctatttgctcctaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57856 - DNA, 2283 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggccttatgccagcctggaccatcttggaggcagtgtaggatcatggaagaactttgaattaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57857 - DNA, 1442 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaagtgcaacaatgcggggttcaacagtaagctttcattaaccagatattatggtaccggctcgatgtat

SEQ ID NO: 57858 - DNA, 1337 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctctta

SEQ ID NO: 57859 - DNA, 2583 bp, Homo sapiens
ggccccactgggctgccgggtgagcccacccgggggtcgcccgggccggcccagctccgccagcttcgggctgcggccttccctccgcttgcagtcgggagggtgggcgtgcccttgcaacccctttcctgtaccttctctgcagagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgccttggtgaattcgtttcctgaaagtttatcgcatacttgtactgggttagccttatgccagcctggaccatcttggaggcagtgtaggatcatggaagaactttgaattaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57860 - DNA, 2113 bp, Homo sapiens
ggcggatctcaccgccgctcaggagatctgttggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57861 - DNA, 2175 bp, Homo sapiens
caggctgtactggtctgggcgttatgggcatcttcataccatctgaagagtgagaagccgctggcagcctgcggatctcatcgccgctcaggctttagatgaaacttcaactatgcctatggtcactatactttctaacgaaattcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57862 - DNA, 2168 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacacggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57863 - DNA, 1945 bp, Homo sapiens
  misc_feature (47)..(47): n is a, c, g, or t
  misc_feature (52)..(52): n is a, c, g, or t
ccccgcccccaatatgggttagaaaaggtctttgttatcacctgcgncctgngggttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57864 - DNA, 2409 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgccttggtgaattcgtttcctgaaagtttatcgcatacttgtactgggttaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgaagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57865 - DNA, 2164 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgaccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57866 - DNA, 1114 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaatgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57867 - DNA, 1130 bp, Homo sapiens
tgtagcgttccgactctagtcttcgtcaccacgtcacttatcgtcaccagttaactatgtccgaaatagcgcgacgcatgcgggacggtcttgactctgtgcctgagtgacctgaggcatcgagctctagttcgtgttcttggtcgttgcttgtgcccctgtgtgattttgttctcccacaaaatgcccgaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57868 - DNA, 2364 bp, Homo sapiens
taggctgcgttgaggcccaaccagggggaggcggggccaaggccaggcctgactaaacctggagactcgggtggccgaggggcttcataccagctgaagagcgacaagccgctggcagccgcggatctcaccgccgctcaggagatctgttggctcaactctgaggcatttttattctcacggtcgctcttggacgaagatgcgagaagagcctgcacagttgtgtctaggatacgtctcagtccagtcatagagatattgggcgagcaattcttccctgtgactctatatcgggtgagttacccgtgcgtcgttttgctctggtggcaacagctggtagatgacgatctctgatcctaactcgtctcgagaatctcatcgtccatcgtccgttggcacacggtcgcctacatgtggcagtacgcatgttgcctttgtgtacagctaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 57869 - DNA, 863 bp, Homo sapiens
agcagattggatattaagtataaatcagctctctgtgtatgtccttgtgtggtggtataactgacaacaggtagggttcctgatgggattgggttccaccaatcagagccacttgcatgagacctcaactgagagccaggatgtcatctccaccagaacaaggactacgttttgtatgttgctgttccgttagtgccagaacatgcccacccctgctcagtaaataagcgttaagtgaatgaattaataagtgaaaggctgtgtttgaagaggaggggctcactctaaatcttgaagatgttcagcctcgaaaaagtagaagtcattgtgaccaaagatgatgccaccatgcctttgaaaaagaaaggtgatgagcctcaaatggaaaaatacattcaagaaaggtcaatgctaccaccattcccctctgcccctccactcctgaggccatcatgatgaagccagtgggaactccagtggaaggacccagacaggaataagatcacctgggccttcaccttccttcaccgaccgagagctcttctcttcctgcgcttttattttaatctaggacatcccctcacttggctcctagaggccctgtttcatttaatttggcctccttgcccaagcagaatcctgggcaagcctgggaacctaataccctgaattcaaatgaagttgcctggaggaaactgaatgaatcaggtagctaagatttggcctaacgttgatctatttttggccaaagccaacctccactaataggtctctactaatagacttgcaaagatggagctctgaatcaatgctaaacaagagttataaatcatgaagacgtttgctgtctttttacctcccag

SEQ ID NO: 57870 - DNA, 523 bp, Homo sapiens
agcagattggatattaagtataaatcagctctctgtgtatgtccttgtgtggtggtataactgacaacaggtagggttcctgatgggattgggttccaccaatcagagccacttgcatgagacctcaactgagagccaggtgtttgaagaggaggggctcactctaaatcttgaagatgttcagcctcgaaaaagtagaagtcattgtgaccaaagatgatgccaccatgcctttgaaaaagaaaggtgatgagcctcaaatggaaaaatacattcaagaaaggtcaatgctagtgagtatgaatgaacacatagcaaaaatttcaggtagaacagccatgccaagggctggtgggacaggtgaggccgagtgaataaaaagaagtagccccagagacactcaaggtggttccagctgcttttgaaggaggtttctttctaagaggtggctgggcttggtttcagcgtattccaatttgggactcatgaactgcaactaataaagatcaaaaaactgatacag

SEQ ID NO: 57871 - DNA, 157 bp, Homo sapiens
agaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaacc

SEQ ID NO: 57872 - DNA, 480 bp, Homo sapiens
gatatatggcctgctgtcccgttcagtctagaaaacgcctcctcagggtccctgcagatggtcacctccctctgcaggaggacgtccagtgggaggagagccacttccccaggtctccctgacactaatgtcagaaggtgctttcttaggttgaatcaaaatctctctccctgtgtcttctctttgcttcctgttcttttctctggagcaacatgatgtaaataagtttattttcttttgtgcacatcagaatttcatattcaaaggacatcatcagctctcttgttagaaggggtccaggctgaacaccctcttttctctcaatgatcccagctatgacacagttttctgatcttcaacatcctggaggcccaagactattcaaatatgtcacaaatatctctaatcacatcttgtgattatgacttggatagaagataaacattatttccataatgatgaacataagacatttgagat

SEQ ID NO: 57873 - DNA, 442 bp, Homo sapiens
tcctgacttttttcagccacagtgagtctctgagacctagttttggcagaaggaagtaccagagggagctgagctgttgaacattatgtgcgatcatgtaataactgcaatcggaagggaaacactcagagtcctggagaaagagaaattcgcatttgtggacgcctgctgggagctaggcactttcgaatagttcctgtcacctaacttaaaatttcatattcaaaggacatcatcagctctcttgttagaaggggtccaggctgaacaccctcttttctctcaatgatcccagctatgacacagttttctgatcttcaacatcctggaggcccaagactattcaaatatgtcacaaatatctctaatcacatcttgtgattatgacttggatagaagataaacattatttccataatgatgaacataagacatttgagat

SEQ ID NO: 57874 - DNA, 432 bp, Homo sapiens
cactctctattcagaaatgcagaagcgcagccagttgcgaaatcacagcgacttgctcaatttgcagtgtgcgatcttctcctgcagggctccaacctgaatatgccaacagagagggcagaaaattccctggccaggctgtggaaggggaaatcatttggatctgtttaaaaggggaaagaattaagagagctgacatttccggaagaaacaacgttcaggcatgcaactggaatttaaatgagtatctgctttcgatgctgacagcaggagccttccctcccatatgcccgcaactgcacactcaaacctcaggtagcacagaaaagaccagcgctccgactcctggggccagtggtgctggattttatttgcacttttctgggtttaaatattttgagaatttttttaaaaagcatttctctcttctct

SEQ ID NO: 57875 - DNA, 411 bp, Homo sapiens
cactctctattcagaaatgcagaagcgcagccagttgcgaaatcacagcgacttgctcaatttgcagtgtgcgatcttctcctgcagggctccaacctgaatatgccaacagagagggcagaaaattccctggccaggctgtggaaggtgcggactggaggctgcgctgtcttgaacctctgccatctcagataaaatagcccaaggcacagtcccatctccctgccggtctccccttccctctccctcactgccagctttaaccttagcaatcatttttaggcgactgatgctcaactacggagaccctttgtcactgctaatgacttctccctgtccatcttctcccgactcgggatatctatggctctgttgccacatttgtcatctctggccagggaggaggcatct

SEQ ID NO: 57876 - DNA, 2412 bp, Homo sapiens
cgggcctggctgaggcggaggttgttgcggatgcttctctctccaggcgcaccgcagattcctgcccgggggttggacccgaggaaccgccgtctctactggttccgacggccagaggctgggccctaggctgagcggagagtgggactggagcctgaaacgggcgcctaaaagaagcccgtgcatcccataggcctgcgcctcaggcttggagacgggcgggcggagaccgcgctgagtctttttttttttttcctagcagctggcgttcttatctcacccgggaggctgtaaaaatctccgtccttaacagtaacaccatcaggtcctatcagttaagagctgcttgttatttgcatgcattcttataattaaatctcctaacaaccctgtaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaagattaa

SEQ ID NO: 57877 - DNA, 2789 bp, Homo sapiens
cgggcctggctgaggcggaggttgttgcggatgcttctctctccaggcgcaccgcagattcctgcccgggggttggacccgaggaaccgccgtctctactggttccgacggccagaggctgggccctaggctgagcggagagtgggactggagcctgaaacgggcgcctaaaagaagcccgtgcatcccataggcctgcgcctcaggcttggagacgggcgggcggagaccgcgctgagtctttttttttttttcctagcagctggcgttcttatctcacccgggaggctgtaaaaatctccgtccttaacagtaacaccatcaggtcctatcagttaagagctgcttgttatttgcatgcattcttataattaaatctcctaacaaccctgtaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaagattaagtactactgcctagttgctatcatgagattttcccaattctaagtatctgtttaacctgttcgtgtggtatatgaaaaagatacctaagcactagaatatccagctaaatggtgcaataggctaggaattgagccaggagaaaagagaagatatcccagaagtcaaaaaggcaaaatgaaagattgagttcgcccgtctttgttatggagaggttaatgaaatcagaagaggattatgaaatataatgggaaaaggaatgatctggcttatgtaagacttacttttaaatatactctttggagttagtctcacaatgtccattcccctagctcctgtgctatgaatatcatattaataaatagcctaatatattaat

SEQ ID NO: 57878 - DNA, 2282 bp, Homo sapiens
ataattcaccaataaaggacttacaggtgttcataacttgtctaagctcaaatctcccatatataacttgctggcaaatcatttattccagggcattagctatgagttgctagctttaagttgaactatatcctgtcatggcttacttcgaattgacatgctgcaggctgtatcttgacatgatacaagatagcatgtgatgtggctttgttttaattcagttagccactggtttttaatgtgtgggttatattctactcccaaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaagattaa

SEQ ID NO: 57879 - DNA, 2486 bp, Homo sapiens
cgggcctggctgaggcggaggttgttgcggatgcttctctctccaggcgcaccgcagattcctgcccgggggttggacccgaggaaccgccgtctctactggttccgacggccagaggctgggccctaggctgagcggagagtgggactggagcctgaaacgggcgcctaaaagaagcccgtgcatcccataggcctgcgcctcaggcttggagacgggcgggcggagaccgcgctgagtctttttttttttttcctagcagctggcgttcttatctcacccgggaggctgtaaaaatctccgtccttaacagtaacaccatcaggtcctatcagttaagagctgcttgttatttgcatgcattcttataattaaatctcctaacaaccctgtaagccacattctctggcacagaactttggaaactttggggatcacttacttatcttggagatagaatgttttctaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaagattaa

SEQ ID NO: 57880 - DNA, 8050 bp, Homo sapiens
gggagggacgaaccgcgcgaccgagccctacaaaacccgccccggccgagtggcgaggcgagctttccagccgggctcccagagcgcgctgcgcaggagacgcggtggcctgagagcctgagggtccccggactcgcccaggctctgagctctctcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactctgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggggcccccggaccacccggagaagccggccctaggggagagctcagtgtttcaacaccagttccaggccctccaggacctccagggccccctggccatcctggcccccaaggtccacctggtatccctggatccctggggaaatgtggagatcctggtcttccagggcctgatggtgaaccaggaattccaggaattggatttcctgggccacctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggatttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactccgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacatgcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtgcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcacgttatgaaatatttggcccgctggattcccacatttgtcttctttctgtctttaagactcagggaggctaaatcagtgtttgattgccccgccaacccttcctgaaacttcagaccctgggtagggaagagaaggggcatgtggtatctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcattcactgtagctctaaaatctgcttgtatccaagcatataaaattttcccccttagtgaattagttttaaaatgatattgttatatacatactatgaaatatgtataactttaacttctgttttaccagcatacgcacacaaataacaagaatactacttatgaaatgtgcactttatcctcattccataaatgttggtgcataccttatgtaagggagcagttcaataatccatgaaagaacttaaggcatttgttggtttatcagactcggaatctatttttctcattgctctgaatatgtcatcactctaggttttacagatttattcctttgttacttctctaattcttcctttgtaaaaaaaaaaaaagcaacacttttttttatgttatatgttgtcttacaaaccatactgaaagagtcattgtttaaaatcttaatgtatcaaactgtataacttggccgctgtatgtcttaaaacctgcttttcaatgtgttgatacattcccaaggttacttaattcaacttaactatcatgttattcagcaccaagcatgtccaggcactgtactaacctacagagatgctaagagaaaaaaaagacttgtttctgatctaatatccagaaaaagtaactcattgctctgtaataatctcacatatacagtagcttcctccctctagttttttcttccttgtcactgctgttatatttcatcatgataattcagcaggccagtaaggtaaaaataaggtctatgcctagggaaactcaggcttctagtttctcttagaaaagctaagagaagataaggtctgaataatagcagaaaaaccaacatctacaaaacattaaactagtgttataccttgatgataacactattgatgagtcttagagtccagacacaaagagacaaagctttgaagatgcttttgatctacctaggtggagttggtggtgctgatatttaaattcaggctactgcttcaatctcaattgctttgtaagtgaaaacatgacccagagacagacagactatggccatggctcacatggtttacatccttcactgctcacgtgtttgctgtcaagccatttttacagtctgaaactaagatgtgcagcatttcacttatttagattcacttaacaaacaaatttttctgctttaaaaatgtcttattgtcccaaggtactatagcggatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctatcaatccaagcacactccgcaggcagttaccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaattccaatgaagccatatgaaccagctgtcagttgcacttctaagactttacttagcagtaaattatagctcatgtgcattatttcagatacttagcttatgagtagcttatacaattagtgaagattaatattacagattaaatgtaactgttcttaaattgggctcacttgattcacagcgtgcatacacagattgtgagaagtcttcagcaagataaacattattaactaacttatttatgaagtattaaaatgcttacatttgaacttgatggctaacttactaagattctctatgtatcaaatgtaacttactgcgactaaacttaatttaatatttactctataaccaaatgaaatatatttaaaatatattgaatattttatattgttatatcctgacaagattgttaatattttaatgtactaatatttctgtcaattatatctaaatattattttattatattgcctaagaataaacatttgttaaattgg

SEQ ID NO: 57881 - DNA, 7872 bp, Homo sapiens
gggagggacgaaccgcgcgaccgagccctacaaaacccgccccggccgagtggcgaggcgagctttccagccgggctcccagagcgcgctgcgcaggagacgcggtggcctgagagcctgagggtccccggactcgcccaggctctgagctctctcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactctgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggggcccccggaccacccggagaagccggccctaggggagagctcagtgtttcaacaccagttccaggccctccaggacctccagggccccctggccatcctggcccccaaggtccacctggtatccctggatccctggggaaatgtggagatcctggtcttccagggcctgatggtgaaccaggaattccaggaattggatttcctgggccacctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggatttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactccgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttgatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacatgcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtgcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcacgttatgaaatatttggcccgctggattcccacatttgtcttctttctgtctttaagactcagggaggctaaatcagtgtttgattgccccgccaacccttcctgaaacttcagaccctgggtagggaagagaaggggcatgtggtatctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcattcactgtagctctaaaatctgcttgtatccaagcatataaaattttcccccttagtgaattagttttaaaatgatattgttatatacatactatgaaatatgtataactttaacttctgttttaccagcatacgcacacaaataacaagaatactacttatgaaatgtgcactttatcctcattccataaatgttggtgcataccttatgtaagggagcagttcaataatccatgaaagaacttaaggcatttgttggtttatcagactcggaatctatttttctcattgctctgaatatgtcatcactctaggttttacagatttattcctttgttacttctctaattcttcctttgtaaaaaaaaaaaaagcaacacttttttttatgttatatgttgtcttacaaaccatactgaaagagtcattgtttaaaatcttaatgtatcaaactgtataacttggccgctgtatgtcttaaaacctgcttttcaatgtgttgatacattcccaaggttacttaattcaacttaactatcatgttattcagcaccaagcatgtccaggcactgtactaacctacagagatgctaagagaaaaaaaagacttgtttctgatctaatatccagaaaaagtaactcattgctctgtaataatctcacatatacagtagcttcctccctctagttttttcttccttgtcactgctgttatatttcatcatgataattcagcaggccagtaaggtaaaaataaggtctatgcctagggaaactcaggcttctagtttctcttagaaaagctaagagaagataaggtctgaataatagcagaaaaaccaacatctacaaaacattaaactagtgttataccttgatgataacactattgatgagtcttagagtccagacacaaagagacaaagctttgaagatgcttttgatctacctaggtggagttggtggtgctgatatttaaattcaggctactgcttcaatctcaattgctttgtaagtgaaaacatgacccagagacagacagactatggccatggctcacatggtttacatccttcactgctcacgtgtttgctgtcaagccatttttacagtctgaaactaagatgtgcagcatttcacttatttagattcacttaacaaacaaatttttctgctttaaaaatgtcttattgtcccaaggtactatagcggatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctatcaatccaagcacactccgcaggcagttaccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaattccaatgaagccatatgaaccagctgtcagttgcacttctaagactttacttagcagtaaattatagctcatgtgcattatttcagatacttagcttatgagtagcttatacaattagtgaagattaatattacagattaaatgtaactgttcttaaattgggctcacttgattcacagcgtgcatacacagattgtgagaagtcttcagcaagataaacattattaactaacttatttatgaagtattaaaatgcttacatttgaacttgatggctaacttactaagattctctatgtatcaaatgtaacttactgcgactaaacttaatttaatatttactctataaccaaatgaaatatatttaaaatatattgaatattttatattgttatatcctgacaagattgttaatattttaatgtactaatatttctgtcaattatatctaaatattattttattatattgcctaagaataaacatttgttaaattgg

SEQ ID NO: 57882 - DNA, 7699 bp, Homo sapiens
gggagggacgaaccgcgcgaccgagccctacaaaacccgccccggccgagtggcgaggcgagctttccagccgggctcccagagcgcgctgcgcaggagacgcggtggcctgagagcctgagggtccccggactcgcccaggctctgagctctctcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactctgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggggcccccggaccacccggagaagccggccctaggggagagctcagtgtttcaacaccagttccaggccctccaggacctccagggccccctggccatcctggcccccaaggtccacctggtatccctggatccctggggaaatgtggagatcctggtcttccagggcctgatggtgaaccaggaattccaggaattggatttcctgggccacctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggatttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactccgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttgatgcactgtttgtgaaggtcctgcgatcgccatagccgttcacagccaaaccactgacattcctccatgtcctcacggctggatttctctctggaaaggattttcattcatcatgaaagcctattccatcaactgtgaaagctggggaattagaaaaaataataagtcgctgtcaggtgtgcatgaagaaaagacactgaagctaaaaaagacatgcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtgcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcacgttatgaaatatttggcccgctggattcccacatttgtcttctttctgtctttaagactcagggaggctaaatcagtgtttgattgccccgccaacccttcctgaaacttcagaccctgggtagggaagagaaggggcatgtggtatctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcattcactgtagctctaaaatctgcttgtatccaagcatataaaattttcccccttagtgaattagttttaaaatgatattgttatatacatactatgaaatatgtataactttaacttctgttttaccagcatacgcacacaaataacaagaatactacttatgaaatgtgcactttatcctcattccataaatgttggtgcataccttatgtaagggagcagttcaataatccatgaaagaacttaaggcatttgttggtttatcagactcggaatctatttttctcattgctctgaatatgtcatcactctaggttttacagatttattcctttgttacttctctaattcttcctttgtaaaaaaaaaaaaagcaacacttttttttatgttatatgttgtcttacaaaccatactgaaagagtcattgtttaaaatcttaatgtatcaaactgtataacttggccgctgtatgtcttaaaacctgcttttcaatgtgttgatacattcccaaggttacttaattcaacttaactatcatgttattcagcaccaagcatgtccaggcactgtactaacctacagagatgctaagagaaaaaaaagacttgtttctgatctaatatccagaaaaagtaactcattgctctgtaataatctcacatatacagtagcttcctccctctagttttttcttccttgtcactgctgttatatttcatcatgataattcagcaggccagtaaggtaaaaataaggtctatgcctagggaaactcaggcttctagtttctcttagaaaagctaagagaagataaggtctgaataatagcagaaaaaccaacatctacaaaacattaaactagtgttataccttgatgataacactattgatgagtcttagagtccagacacaaagagacaaagctttgaagatgcttttgatctacctaggtggagttggtggtgctgatatttaaattcaggctactgcttcaatctcaattgctttgtaagtgaaaacatgacccagagacagacagactatggccatggctcacatggtttacatccttcactgctcacgtgtttgctgtcaagccatttttacagtctgaaactaagatgtgcagcatttcacttatttagattcacttaacaaacaaatttttctgctttaaaaatgtcttattgtcccaaggtactatagcggatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctatcaatccaagcacactccgcaggcagttaccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaattccaatgaagccatatgaaccagctgtcagttgcacttctaagactttacttagcagtaaattatagctcatgtgcattatttcagatacttagcttatgagtagcttatacaattagtgaagattaatattacagattaaatgtaactgttcttaaattgggctcacttgattcacagcgtgcatacacagattgtgagaagtcttcagcaagataaacattattaactaacttatttatgaagtattaaaatgcttacatttgaacttgatggctaacttactaagattctctatgtatcaaatgtaacttactgcgactaaacttaatttaatatttactctataaccaaatgaaatatatttaaaatatattgaatattttatattgttatatcctgacaagattgttaatattttaatgtactaatatttctgtcaattatatctaaatattattttattatattgcctaagaataaacatttgttaaattgg

SEQ ID NO: 57883 - DNA, 7375 bp, Homo sapiens
gggagggacgaaccgcgcgaccgagccctacaaaacccgccccggccgagtggcgaggcgagctttccagccgggctcccagagcgcgctgcgcaggagacgcggtggcctgagagcctgagggtccccggactcgcccaggctctgagctctctcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactctgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggggcccccggaccacccggagaagccggccctaggggagagctcagtgtttcaacaccagttccaggccctccaggacctccagggccccctggccatcctggcccccaaggtccacctggtatccctggatccctggggaaatgtggagatcctggtcttccagggcctgatggtgaaccaggaattccaggaattggatttcctgggccacctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggatttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactccgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaaagcctattccatcaactgtgaaagctggggaattagaaaaaataataagtcgctgtcaggtgtgcatgaagaaaagacactgaagctaaaaaagacatgcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtgcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcacgttatgaaatatttggcccgctggattcccacatttgtcttctttctgtctttaagactcagggaggctaaatcagtgtttgattgccccgccaacccttcctgaaacttcagaccctgggtagggaagagaaggggcatgtggtatctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcattcactgtagctctaaaatctgcttgtatccaagcatataaaattttcccccttagtgaattagttttaaaatgatattgttatatacatactatgaaatatgtataactttaacttctgttttaccagcatacgcacacaaataacaagaatactacttatgaaatgtgcactttatcctcattccataaatgttggtgcataccttatgtaagggagcagttcaataatccatgaaagaacttaaggcatttgttggtttatcagactcggaatctatttttctcattgctctgaatatgtcatcactctaggttttacagatttattcctttgttacttctctaattcttcctttgtaaaaaaaaaaaaagcaacacttttttttatgttatatgttgtcttacaaaccatactgaaagagtcattgtttaaaatcttaatgtatcaaactgtataacttggccgctgtatgtcttaaaacctgcttttcaatgtgttgatacattcccaaggttacttaattcaacttaactatcatgttattcagcaccaagcatgtccaggcactgtactaacctacagagatgctaagagaaaaaaaagacttgtttctgatctaatatccagaaaaagtaactcattgctctgtaataatctcacatatacagtagcttcctccctctagttttttcttccttgtcactgctgttatatttcatcatgataattcagcaggccagtaaggtaaaaataaggtctatgcctagggaaactcaggcttctagtttctcttagaaaagctaagagaagataaggtctgaataatagcagaaaaaccaacatctacaaaacattaaactagtgttataccttgatgataacactattgatgagtcttagagtccagacacaaagagacaaagctttgaagatgcttttgatctacctaggtggagttggtggtgctgatatttaaattcaggctactgcttcaatctcaattgctttgtaagtgaaaacatgacccagagacagacagactatggccatggctcacatggtttacatccttcactgctcacgtgtttgctgtcaagccatttttacagtctgaaactaagatgtgcagcatttcacttatttagattcacttaacaaacaaatttttctgctttaaaaatgtcttattgtcccaaggtactatagcggatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctatcaatccaagcacactccgcaggcagttaccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaattccaatgaagccatatgaaccagctgtcagttgcacttctaagactttacttagcagtaaattatagctcatgtgcattatttcagatacttagcttatgagtagcttatacaattagtgaagattaatattacagattaaatgtaactgttcttaaattgggctcacttgattcacagcgtgcatacacagattgtgagaagtcttcagcaagataaacattattaactaacttatttatgaagtattaaaatgcttacatttgaacttgatggctaacttactaagattctctatgtatcaaatgtaacttactgcgactaaacttaatttaatatttactctataaccaaatgaaatatatttaaaatatattgaatattttatattgttatatcctgacaagattgttaatattttaatgtactaatatttctgtcaattatatctaaatattattttattatattgcctaagaataaacatttgttaaattgg

SEQ ID NO: 57884 - DNA, 441 bp, Homo sapiens
ccggccgagtggcgaggcgagctttccagccgggctcccagagcgcgctgcgcaggagacgcggtggcctgagagcctgagggtccccggactcgcccaggctctgagctctctcccaccatgagcgcccggaccgcccccaggccgcaggtgctcctgctgccgctcctgctggtgctcctggcggcggcgcccgcagccagcaaggtgagtgggggctgcgcgacccccacccccgcacttccatccctcctccacgcgtccgggggacgcgctggccccacccgcagcggcgcggtagtggagcggctgccgggctagtggcgaggctgagggcttcacgcaggtcccgggacaggcagcgagcggaagggagcaagcggggatgccccggaacaggtggaatgcgcggggctgggggaagaggcgaggagggggctt

SEQ ID NO: 57885 - DNA, 7877 bp, Homo sapiens
gggagggacgaaccgcgcgaccgagccctacaaaacccgccccggccgagtggcgaggcgagctttccagccgggctcccagagcgcgctgcgcaggagacgcggtggcctgagagcctgagggtccccggactcgcccaggctctgagctctctcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactctgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggggcccccggaccacccggagaagccggccctaggggagagctcagtgtttcaacaccagttccaggccctccaggacctccagggccccctggccatcctggcccccaaggtccacctggtatccctggatccctggggaaatgtggagatcctggtcttccagggcctgatggtgaaccaggaattccaggaattggatttcctgggccacctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggatttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactccgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgaaagcctattccatcaactgtgaaagctggggaattagaaaaaataataagtcgctgtcaggtgtgcatgaagaaaagacactgaagctaaaaaagacatgcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtgcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcacgttatgaaatatttggcccgctggattcccacatttgtcttctttctgtctttaagactcagggaggctaaatcagtgtttgattgccccgccaacccttcctgaaacttcagaccctgggtagggaagagaaggggcatgtggtatctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcattcactgtagctctaaaatctgcttgtatccaagcatataaaattttcccccttagtgaattagttttaaaatgatattgttatatacatactatgaaatatgtataactttaacttctgttttaccagcatacgcacacaaataacaagaatactacttatgaaatgtgcactttatcctcattccataaatgttggtgcataccttatgtaagggagcagttcaataatccatgaaagaacttaaggcatttgttggtttatcagactcggaatctatttttctcattgctctgaatatgtcatcactctaggttttacagatttattcctttgttacttctctaattcttcctttgtaaaaaaaaaaaaagcaacacttttttttatgttatatgttgtcttacaaaccatactgaaagagtcattgtttaaaatcttaatgtatcaaactgtataacttggccgctgtatgtcttaaaacctgcttttcaatgtgttgatacattcccaaggttacttaattcaacttaactatcatgttattcagcaccaagcatgtccaggcactgtactaacctacagagatgctaagagaaaaaaaagacttgtttctgatctaatatccagaaaaagtaactcattgctctgtaataatctcacatatacagtagcttcctccctctagttttttcttccttgtcactgctgttatatttcatcatgataattcagcaggccagtaaggtaaaaataaggtctatgcctagggaaactcaggcttctagtttctcttagaaaagctaagagaagataaggtctgaataatagcagaaaaaccaacatctacaaaacattaaactagtgttataccttgatgataacactattgatgagtcttagagtccagacacaaagagacaaagctttgaagatgcttttgatctacctaggtggagttggtggtgctgatatttaaattcaggctactgcttcaatctcaattgctttgtaagtgaaaacatgacccagagacagacagactatggccatggctcacatggtttacatccttcactgctcacgtgtttgctgtcaagccatttttacagtctgaaactaagatgtgcagcatttcacttatttagattcacttaacaaacaaatttttctgctttaaaaatgtcttattgtcccaaggtactatagcggatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctatcaatccaagcacactccgcaggcagttaccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaattccaatgaagccatatgaaccagctgtcagttgcacttctaagactttacttagcagtaaattatagctcatgtgcattatttcagatacttagcttatgagtagcttatacaattagtgaagattaatattacagattaaatgtaactgttcttaaattgggctcacttgattcacagcgtgcatacacagattgtgagaagtcttcagcaagataaacattattaactaacttatttatgaagtattaaaatgcttacatttgaacttgatggctaacttactaagattctctatgtatcaaatgtaacttactgcgactaaacttaatttaatatttactctataaccaaatgaaatatatttaaaatatattgaatattttatattgttatatcctgacaagattgttaatattttaatgtactaatatttctgtcaattatatctaaatattattttattatattgcctaagaataaacatttgttaaattgg

SEQ ID NO: 57886 - DNA, 7584 bp, Homo sapiens
gggagggacgaaccgcgcgaccgagccctacaaaacccgccccggccgagtggcgaggcgagctttccagccgggctcccagagcgcgctgcgcaggagacgcggtggcctgagagcctgagggtccccggactcgcccaggctctgagctctctcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactctgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggggcccccggaccacccggagaagccggccctaggggagagctcagtgtttcaacaccagttccaggccctccaggacctccagggccccctggccatcctggcccccaaggtccacctggtatccctggatccctggggaaatgtggagatcctggtcttccagggcctgatggtgaaccaggaattccaggaattggatttcctgggccacctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggatttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactccgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttgaaagcctattccatcaactgtgaaagctggggaattagaaaaaataataagtcgctgtcaggtgtgcatgaagaaaagacactgaagctaaaaaagacatgcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtgcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcacgttatgaaatatttggcccgctggattcccacatttgtcttctttctgtctttaagactcagggaggctaaatcagtgtttgattgccccgccaacccttcctgaaacttcagaccctgggtagggaagagaaggggcatgtggtatctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcattcactgtagctctaaaatctgcttgtatccaagcatataaaattttcccccttagtgaattagttttaaaatgatattgttatatacatactatgaaatatgtataactttaacttctgttttaccagcatacgcacacaaataacaagaatactacttatgaaatgtgcactttatcctcattccataaatgttggtgcataccttatgtaagggagcagttcaataatccatgaaagaacttaaggcatttgttggtttatcagactcggaatctatttttctcattgctctgaatatgtcatcactctaggttttacagatttattcctttgttacttctctaattcttcctttgtaaaaaaaaaaaaagcaacacttttttttatgttatatgttgtcttacaaaccatactgaaagagtcattgtttaaaatcttaatgtatcaaactgtataacttggccgctgtatgtcttaaaacctgcttttcaatgtgttgatacattcccaaggttacttaattcaacttaactatcatgttattcagcaccaagcatgtccaggcactgtactaacctacagagatgctaagagaaaaaaaagacttgtttctgatctaatatccagaaaaagtaactcattgctctgtaataatctcacatatacagtagcttcctccctctagttttttcttccttgtcactgctgttatatttcatcatgataattcagcaggccagtaaggtaaaaataaggtctatgcctagggaaactcaggcttctagtttctcttagaaaagctaagagaagataaggtctgaataatagcagaaaaaccaacatctacaaaacattaaactagtgttataccttgatgataacactattgatgagtcttagagtccagacacaaagagacaaagctttgaagatgcttttgatctacctaggtggagttggtggtgctgatatttaaattcaggctactgcttcaatctcaattgctttgtaagtgaaaacatgacccagagacagacagactatggccatggctcacatggtttacatccttcactgctcacgtgtttgctgtcaagccatttttacagtctgaaactaagatgtgcagcatttcacttatttagattcacttaacaaacaaatttttctgctttaaaaatgtcttattgtcccaaggtactatagcggatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctatcaatccaagcacactccgcaggcagttaccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaattccaatgaagccatatgaaccagctgtcagttgcacttctaagactttacttagcagtaaattatagctcatgtgcattatttcagatacttagcttatgagtagcttatacaattagtgaagattaatattacagattaaatgtaactgttcttaaattgggctcacttgattcacagcgtgcatacacagattgtgagaagtcttcagcaagataaacattattaactaacttatttatgaagtattaaaatgcttacatttgaacttgatggctaacttactaagattctctatgtatcaaatgtaacttactgcgactaaacttaatttaatatttactctataaccaaatgaaatatatttaaaatatattgaatattttatattgttatatcctgacaagattgttaatattttaatgtactaatatttctgtcaattatatctaaatattattttattatattgcctaagaataaacatttgttaaattgg

SEQ ID NO: 57887 - DNA, 327 bp, Homo sapiens
tgccatgtcaggaataaaacacacttctgattgactgcaaaattgatggccaataagaggtcaagctggttacgatctggtatctagaaatgattagctaggttacctagagtaatacacttaactttctgagcctcagcttattgaaacagaacaaaacaaaatctaacaacagcaacacatatttacctatatgttcagtagcactttcatttgtgatcttctaattttgctttaagtcccaaagtttaagacaacatcttcaagtaagaaagggagattctttttaaaaagtacttgagcaattagaaattggagtaagggtta

SEQ ID NO: 57888 - DNA, 302 bp, Homo sapiens
aaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcgtgtctactggggccagggaaccctggtcaccgtctcctca

SEQ ID NO: 57889 - DNA, 350 bp, Homo sapiens
agagttggtatgaaaaagaaatgagaaaactataacaatgatcacaatggctggtgtttggaaggtgcttaaaactcaatgtgaacggctttctgagattcttctctaacttcggttttcaatacccgcaataagggaaagaaaatatggtatcagtaggtctccagaggatgctaaagtgttggagaggtgaggaaggggaaatattaggtcctgctaataaacttgatcagcttttaagtatcgtcaggtttagataactggagcacatttgccttatcaataagtaccatattttaaaatagatatgaattttattctgtgtatttttacctggtggaatatgtata

SEQ ID NO: 57890 - DNA, 342 bp, Homo sapiens
cagactttaaagatatccagttccctatttgctactcctgtgcttttgattcagtagttctgggaagagagctcagtgtccacatattacagtgctctttaaagattcagaaggaggcagtcagtggaggaatttgtgaaatattttcctaagtccatctgtaatgtcttctttcctacagaaacatagggctggggatctagaaaacttccaacatgtcatgtttcctactttttataagcaggagtctctttctaacctgttggagcaaggcaaagagccctggactgtgtagcatgaagtgaaaataagatgggtgggaattttttttttttttttttt

SEQ ID NO: 57891 - DNA, 380 bp, Homo sapiens
agtcatctaacctgcttggttttccagaaaatgtattatggtcacaccagtatattgtggcttatagcattgctcaaaaaaagacagactcaacttttagatgagatcagggaaacaagtgagtcaaaacctgttgaacactagcaaagcctttccttttcatttgatgtattgtgtgtattaagacaccttttttaggctgggcacagtgtaatcccagcactttgggaggcggagacagaaggattgcttgagctcaggagttcaagaccagcctgggcaacgtagtgagacccccatctttacaaaaaatttttacaaattagctgggcctggtggcacacacctgtagtcccagctattcaggaggctgaggcagg

SEQ ID NO: 57892 - DNA, 1651 bp, Homo sapiens
cacctcttcgactttgctcctgcttcaccagtgatgtcctccctggggtcagtttaccctgcgtgggaggtgaattccctgggggaaacttaggctcccttctgctgctcttgtgcagtgcacggggctgtcctcattttctccgttccccattgcttctttaatgtctcagtgcacttccttcattccattgccaaaatgcaagccccttgagggcagggaccatgcttgactcgtttttgtatgcctaatgcctagcacagagttgaacacattactgccaattcatttttttcaatgacaattccataaacatcattaggcattaggtgttcagctctgcatataaggtcttcatcagcaagacggttacaagtataaaccatttcctatttcagaatattttaatattcaacatatttgtatacccacattctcttgttacaattattgccagaaagccaattgataagctttcaaaatgggcttatcacacccctccaaaaatagatttttgttttttctataaacagaaatttcagaaatgagatttgagagatccgactgagaagacccttcagtaaaatgtgacatgacttaccttatgctgtaatctgtattccctcaggatttaagagcttcctagcataaaatctttgctaaacgtttgtgtacatgttattggtgctccgaaaaatagtcaatggaatggtgcactacaattgggctttatcatcttattttgaacctcgtgtagattacagtaaagcaaaccattcagtgtgttccaggaaattatattagatctgtgtttctatcagctcactggaataatctgataattgttacttttacttggtatggctgcaagaatagtggaaagaagaggacttgagagttggtcgaacccaggtttgaaatctggcttagtcatttttcagctgttatcctgggtgagttttgccaactttcttagcttcatttccctcattaatacggtgggacataacagctactcttgcattgaaaattaagttagattacctgtctagcatacccatcatcatacacttactatggtcacattttgtatttaaaataaactaatacgaaaaatatttctttttttttacacagaattatgattctcacagggtatataaattactgattagaattatttatatgtggccaattcttaatgtcattgggaatgctgtttcatttcaatcctcaaagttactgtagcacagaaaatatcacaatttcctgcagggacattatcagtaagttctgcagggaacaaacaattgacattaaaaatcagtactctgcaattgtcactgttatcatctgctagaaactctgcataatgcattttaaaccaccaaggctggctgccacatccatgtgaaatgcttgaattttatggtgcttaaatatttaatgattcatgggaaaaatgtgaaatgtgtctaataaattgcatccctttctctaacctctggttgtaaagttaaagactttcagcatgtaacttttgcaagatgcctggtctgccattggcacttaaatatttgttgtattacgatttataatatggttcattatatataaaattctgtgatgacttccaaaaacaactgtgttt

SEQ ID NO: 57893 - DNA, 1634 bp, Homo sapiens
  misc_feature (1400)..(1400): n is a, c, g, or t
  misc_feature (1406)..(1406): n is a, c, g, or t
  misc_feature (1412)..(1412): n is a, c, g, or t
  misc_feature (1427)..(1427): n is a, c, g, or t
  misc_feature (1432)..(1433): n is a, c, g, or t
  misc_feature (1457)..(1457): n is a, c, g, or t
  misc_feature (1463)..(1463): n is a, c, g, or t
  misc_feature (1478)..(1478): n is a, c, g, or t
  misc_feature (1480)..(1480): n is a, c, g, or t
  misc_feature (1490)..(1490): n is a, c, g, or t
  misc_feature (1492)..(1492): n is a, c, g, or t
  misc_feature (1497)..(1497): n is a, c, g, or t
  misc_feature (1503)..(1503): n is a, c, g, or t
  misc_feature (1526)..(1526): n is a, c, g, or t
  misc_feature (1528)..(1528): n is a, c, g, or t
  misc_feature (1530)..(1531): n is a, c, g, or t
  misc_feature (1554)..(1555): n is a, c, g, or t
  misc_feature (1560)..(1561): n is a, c, g, or t
  misc_feature (1564)..(1564): n is a, c, g, or t
  misc_feature (1566)..(1566): n is a, c, g, or t
  misc_feature (1568)..(1568): n is a, c, g, or t
  misc_feature (1588)..(1588): n is a, c, g, or t
  misc_feature (1601)..(1601): n is a, c, g, or t
  misc_feature (1605)..(1605): n is a, c, g, or t
  misc_feature (1610)..(1610): n is a, c, g, or t
cacctcttcgactttgctcctgcttcaccagtgatgtcctccctggggtcagtttaccctgcgtgggaggtgaattccctgggggaaacttaggctcccttctgctgctcttgtgcagtgcacggggctgtcctcattttctccgttccccattgcttctttaatgtctcagtgcacttccttcattccattgccaaaatgcaagccccttgagggcagggaccatgcttgactcgtttttgtatgcctaatgcctagcacagagttgaacacattactgccaattcatttttttcaatgacaattccataaacatcattaggcattaggtgttcagctctgcatataaggtcttcatcagcaagacggttacaagtataaaccatttcctatttcagaatattttaatattcaacatatttgtatacccacattctcttgttacaattattgccagaaagccaattgataagctttcaaaatgggcttatcacacccctccaaaaatagatttttgttttttctataaacagaaatttcagaaatgagatttgagagatccgactgagaagacccttcagtaaaatgtgacatgacttaccttatgctgtaatctgtattccctcaggatttaagagcttcctagcataaaatctttgctaaacgtttgtgtacatgttattggtgctccgaaaaatagtcaatggaatggtgcactacaattgggctttatcatcttattttgaacctcgtgtagattacagtaaagcaaaccattcagtgtgttccaggaaattatattagatctgtgtttctatcagctcactggaataatctgataattgttacttttacttggtatggctgcaagaatagtggaaagaagaggacttgagagttggtcgaacccaggtttgaaatctggcttagtcatttttcagctgttatcctgggtgagttttgccaactttcttagcttcatttccctcattaatacggtgggacataacagctactcttgcattgaaaattaagttagattacctgtctagcatacccatcatcatacacttactatggtcacattttgtatttaaaataaactaatacgaaaaatatttctttttttttacacagaattatgattctcacagggtatataaattactgattagaattatttatatgtggccaattcttaatgtcattgggaatgctgtttcatttcaatcctcaaagttactgtagcacagaaaatatcacaatttcctgcagggacattatcagtaagttctgcagggaacaaacaattgacattaaaaatcagtactctgcaattgtcactgttatcatctgctagaaactctgcataatgcattttaaaccaccaaggctggccncccccncctctntgcaatgctttattnagatnncctcacaaggttcaatgttcactntgatanggtgttttgcctctnangaaaggcttncngttcnttttcnttagccgggtaaggggttcacanangnncagtcttttgttctttatgcctnntatgnnttngntnaataatgtttgttgtcaatngtttattaatacngttntttanagttcaaattatgtaatgacttcc

SEQ ID NO: 57894 - DNA, 474 bp, Homo sapiens
gtctggatctcagtccctgactcagaccctggatgctcgctgccttgtacagaaacaacctgctcaaccaaacagggtgaccctgctgaagccgcaaatgtccaacagtcctgccaaccgtggatgcttctgtagcttccctttagctctccctcctggcatgaaaccagacacagactacccagaagatgaactgagcactctgcaatgggcccagcacgctgctgcatctgagaccatcttctcggccctaacaaccctggcaggctcttctctctggtggggaaattgggcttagggaaaggacatctttaggacagtcatcccaccaagtagaatgactctatgcagcctgaatactgtttccctgggaggaaaaaaatccaaagcataaacttttataagctgttttaattaaaacactctttgtaaagtgatgtatttgaagcaagggaggagaaaggttttctggca

SEQ ID NO: 57895 - DNA, 314 bp, Homo sapiens
ttcaagtaaaaagagttagtcctggagaatatcggcagagagatagcatagccagcagaactcggtctaggtctcagaggccaaacaacactatcacctatgaaagtgagcgaggaggtttcaggcgtacgttttcacgttctgagtgggcaggtgtgagaacctatgtcagtagcaccagaatccccatttgtagaatcttaaatactggtttatgtgagactacatctgttgcaattcagacgatgttaaggcagataatgacaggttttggtgagttaagctattttatgtacagtgatagcgactcagag

SEQ ID NO: 57896 - DNA, 733 bp, Homo sapiens
cggtagcgacacggagccggctcccccttttccagccttcctccccatctcccattctccgtcccccacgacctataccagaggtccttaggcctccacgtctctccttttgccgagtagcccaaggtttccacccatctgccagggggatggcgtccactccgatggggaatgagggggagaagaagagcagctggccatctcaagctgcaccctccttgagaggaggtccggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcaaaaaaaaaccgctccacccaccccccggccctcccccccg

SEQ ID NO: 57897 - DNA, 771 bp, Homo sapiens
cggtagcgacacggagccggctcccccttttccagccttcctccccatctcccattctccgtcccccacgacctataccagaggtccttaggcctccacgtctctccttttgccgagtagcccaaggtttccacccatctgccagggggatggcgtccactccgatggggaatgagggggagaagaagagcagctggccatctcaagctgcaccctccttgagaggaggtccggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagccctctcccctctcttccaccatctcctgctcggacagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcaaaaaaaaaccgctccacccaccccccggccctcccccccg

SEQ ID NO: 57898 - DNA, 356 bp, Homo sapiens
attttgaattaattttgctttataattatgtatggttccaaaatctaacctacaacacaaaacacatttagaagtcttaactttttctcttatcctctctacctagtccctgctttaatctgtaaattcatttttggtttacccgttgtgactactagaggttaggctaaaacctgggtttcttaaaactgggaaagatacagataagccattcatgcagaggtacatgcaattctggtgttagataaaaactaatgccacaattgtaactacagcctgcaattccagaaaaagaagttaacaccgtgtgtgaggaaaacaacaaaaaaacccccactgtttaaaattcaggattg

SEQ ID NO: 57899 - DNA, 1324 bp, Homo sapiens
agcgggagggtggcagagcccagccaccagggtctgctccatgcctggtccctggagaggccctcaccctctctgctttcacccaacccgactgacacggagtaggaggtgggaatcatgcaggcagggagcttaggaagcctggttcaagattgctttgaatggcaggccccctgctgtgctcctggggagagagcctgaaacctggatgctcgggagcccctcagatccgtcatctgtccccgacacccctgtggtgagccttgccactgggccctgagaagctcagagcagtcgagtcagggcagtgggacatgacccaggtcagatgtggcttttccgtaattgtacaccaatgatcaagagaaaatgaaggattttaatatccaggaagatcctccgcctcagtgccaggccactgcccaccacatgggagcaggaaccagggcatgggcaggcagaagagcaggcggagcggctgagctcctgtcccggctccctaaggtgttcccagtttgcggaggattacgtgccctctcagcccagtagcacactttccaaataagccatcagactcctcccaagatcctgaaactgaggctcagagagcagaagcagcttggccaaagtcatacaactggtagttggtaaaggagctggccttgaactcagggatatcttgaaagccactgttgcttctatggactctagccattcaaaagacccctcaccttctataagaccccaggagatcctcagggtccaactgctcccttgaaaaccaggtcccagatatatctgccaaaggtatgattaggtgccttaaacacataccatgagaaagggattccatgtcttccaatcctgcccagagatgcagagacaccaccacccagggagagatagccagaaactaaaataagatgttagagacagggtggttgatagtgacagatacagccacaccaagacaggctcaaagggaggaagactgaggggaagccagagacagagagggacacattaggccaaagaatgagagagatagctggaaaaggagacaataggagtagaggagggtacaggctgacatgaaaaaacaccgacagatacactccagtatgcagacagacacatatagacccatctgaccttcacaagaaacagactgtgaaagcaagcaaggctcaggctgtgtgtggtgtgcgtatgtgtgtgtgcgtattgtggggggagcatgcagagtctgtatagctacgcacattacaccagctgcttccagcaatttcatctgattaataataaatgccccataattacagcc

SEQ ID NO: 57900 - DNA, 995 bp, Homo sapiens
agcgggagggtggcagagcccagccaccagggtctgctccatgcctggtccctggagaggccctcaccctctctgctttcacccaacccgactgacacggagtaggaggtgggaatcatgcaggcagggagcttaggaagcctggttcaagattgctttgaatggcaggccccctgctgtgctcctggggagagagcctgaaacctggatgctcgggagcccctcagatccgtcatctgtccccgacacccctgtgatcctgaaactgaggctcagagagcagaagcagcttggccaaagtcatacaactggtagttggtaaaggagctggccttgaactcagggatatcttgaaagccactgttgcttctatggactctagccattcaaaagacccctcaccttctataagaccccaggagatcctcagggtccaactgctcccttgaaaaccaggtcccagatatatctgccaaaggtatgattaggtgccttaaacacataccatgagaaagggattccatgtcttccaatcctgcccagagatgcagagacaccaccacccagggagagatagccagaaactaaaataagatgttagagacagggtggttgatagtgacagatacagccacaccaagacaggctcaaagggaggaagactgaggggaagccagagacagagagggacacattaggccaaagaatgagagagatagctggaaaaggagacaataggagtagaggagggtacaggctgacatgaaaaaacaccgacagatacactccagtatgcagacagacacatatagacccatctgaccttcacaagaaacagactgtgaaagcaagcaaggctcaggctgtgtgtggtgtgcgtatgtgtgtgtgcgtattgtggggggagcatgcagagtctgtatagctacgcacattacaccagctgcttccagcaatttcatctgattaataataaatgccccataattacagcc

SEQ ID NO: 57901 - DNA, 890 bp, Homo sapiens
agcgggagggtggcagagcccagccaccagggtctgctccatgcctggtccctggagaggccctcaccctctctgctttcacccaacccgactgacacggagtaggaggtgggaatcatgcaggcagggagcttaggaagcctggttcaagatcctgaaactgaggctcagagagcagaagcagcttggccaaagtcatacaactggtagttggtaaaggagctggccttgaactcagggatatcttgaaagccactgttgcttctatggactctagccattcaaaagacccctcaccttctataagaccccaggagatcctcagggtccaactgctcccttgaaaaccaggtcccagatatatctgccaaaggtatgattaggtgccttaaacacataccatgagaaagggattccatgtcttccaatcctgcccagagatgcagagacaccaccacccagggagagatagccagaaactaaaataagatgttagagacagggtggttgatagtgacagatacagccacaccaagacaggctcaaagggaggaagactgaggggaagccagagacagagagggacacattaggccaaagaatgagagagatagctggaaaaggagacaataggagtagaggagggtacaggctgacatgaaaaaacaccgacagatacactccagtatgcagacagacacatatagacccatctgaccttcacaagaaacagactgtgaaagcaagcaaggctcaggctgtgtgtggtgtgcgtatgtgtgtgtgcgtattgtggggggagcatgcagagtctgtatagctacgcacattacaccagctgcttccagcaatttcatctgattaataataaatgccccataattacagcc

SEQ ID NO: 57902 - DNA, 496 bp, Homo sapiens
agcgggagggtggcagagcccagccaccagggtctgctccatgcctggtccctggagaggccctcaccctctctgctttcacccaacccgactgacacggagtaggaggtgggaatcatgcaggcagggagcttaggaagcctggttcaagattgctttgaatggcaggccccctgctgtgctcctggggagagagcctgaaacctggatgctcgggagcccctcagatccgtcatctgtccccgacacccctgtggtgagccttgccactgggccctgagaagctcagagcagtcgagtcagggcagtgggacatgacccaggtcagatgtggcttttccgtaattgtacaccaatgatcaagagaaaatgaaggattttaatataatgggctgcaaatgtaacaaaccccctgaccttcagtctgaagagagagaactatcaaccacacagaagcaaagatccagagaaatactgagggatgctaccagacact

SEQ ID NO: 57903 - DNA, 421 bp, Homo sapiens
tgaggtgggagggtcacttgagcgtgggaggcgaaggttgcactgagccaagattgagccactgcactctccagcctgggtgaccaagtgaaaccctatggcaaaaaaaaaaaaaaaaaaaaacacaagctttggaggtaatcctgtttctgttttacagatcctgaaactgaggctcagagagcagaagcagcttggccaaagtcatacaactggtagttggtaaaggagctggccttgaactcagggatatcttgaaagccactgttgcttctatggactctagccattcaaaagacccctcaccttctataagaccccaggagatcctcagggtccaactgctcccttgaaaaccaggtcccagatatatctgccaaaggtatgattaggtgccttaaacacataccatgagaaaggg

SEQ ID NO: 57904 - DNA, 786 bp, Homo sapiens
gaatcgcctgaacctaagaggcagaggttgcagtgagccaagattgtgccactgcactccaacctgggcaacagagctagactcaaaaaaaaaaaaaaaaaagaacaaaactattctgactttctcgttgcagagtttaagttctatacagttccctctatgcatgcataaagttttgtgacaatatctgaacttgaccaagatcaaaacataacttctttaaaaaaatcatttaaattcagtttgaaccaaaatcagaaatgatgaagttagcagttactaagattacacatcattcaacaaatatacactgagggcttactatgaactaagtacatatatcaacaaaatttaagacttgaaaataacctgaaaaactgtaaaaacaaaaaggttacatgaaaagggaaccaaaaacagctacctatgattaattatgtagattaagaaaggaattcaggagcctctgaggctcctgatctgaagaaatctcaacacgggagcgcatccctttgccaacaataataaacttcatcagctattttactaatggagacctctgttcatcttcccaaaatagacagcaaaaaacgctgaagatagagaatggcaggcaagttaaatacactgatagcataaattatcttgattaaaagaaggaggtagtggctcatgcctgtaatcccagcactccaacaaaagtgaagtctcccaacagtttgaataggaaacaacaaataaagcaccaaaaaagagactggaaaagctttatagtcactatattga

SEQ ID NO: 57905 - DNA, 369 bp, Homo sapiens
tcgatattgttgtgtttcagagaatagggaggcccaaggataggggaagagatgggggaatgactggttggtccatgggataagaacacacacaacatttattaagtttgctgtcttatgtgggaatggttcatgatgccccaaaacaattacaatagtagtatcaaaggttacttatgacagatcaccatgacagatatgataataatgagaatgtttgaaatattgaattactaaaatgtgacacaaagtgagcatatgctgttggaaaatggcaccaagagacttgcttgatgcagagttgctacaaaccttgaattttagaaaagcacaatatctgcgaagtgtaataaagtaaagtaaaatgaa

SEQ ID NO: 57906 - DNA, 602 bp, Homo sapiens
agccaggattccagccaggatctgcctgactttaagtaatatgtgtttcccactaaacccatgtcatggctttccccagctctcgaagctttgatggccccactgcctactgaattcagtcttagctgccaatccaggggccaagccctccgtgccctgccctgccctactcttcagccttgcccagcttttcccctccatgaacatcctcaagtcccccccacactcaagactccccaggagtgtccctttgctcatctgcaatgtccttactaccagcccatctgccctttccaagtcctgctcactcatcaatacttctgtgaccccctgccgtgagaacacattctctgctaaacccctgctcttccagcgcactttcctcagagttatgtacagagagggtctccccctgctagactgagccacctcggaggaagagcctgtgcctggattttcacatctttgtatgtccttccatccttagcaaaggcacctggaatgtaatcaaaatcaccaaatatgtgttggatagatgaataggtggatggattataaataaataaagtatttatctaggttgttacctctcaggatgcaag

SEQ ID NO: 57907 - DNA, 298 bp, Homo sapiens
aatcatggtggaaggcaaaggaggaacaaagtcatgtcttacatggcagcaggcaaaaggatgactagttcaaccattgtggaagacagtgtggcgattcctcagggatctagaactagaaataccatttgacccagccatcccattactgggtatatgcccaaaggaatataaatcatgctccttctctgattttagaaaaaggtgctacctagttgctaacagtctggaaggagtcatttgacaattccccatctcatctgctatatcgaatctatcaccaaattttgactgtagt

SEQ ID NO: 57908 - DNA, 438 bp, Homo sapiens
aagggggaactccttgaagatttacaaggctctctctctctagctccctcctctctgacactctggcttacaaaatccagctgcatctgcctcccaagtctggatccacgtctcctccactcatccagaccactctgcagtctgcgtggctccccctccacacgtgggctgtgcctccagacacagggcgttcttaggactcaactcatttgcctcttttctctcagaaacgagcaatacgctacccactgtctagtgttggaaacggctgctccagatattttgcccagttttctggttcttcatggtgggtgcaaactctgaagccagtgactcccttgtggcctaaggcagaagtctcctgactccatacatttcaaacctcatttctcctccacccagtgcttccagtgccagtgcctgcagctcctgttcata

SEQ ID NO: 57909 - DNA, 153 bp, Homo sapiens
caaatgcatggttactgcaaccagcgtctgggaaagccagcgcacaaaaactctctttaaggaactcctacagagtcttccccactaaaagcattaagaatcaaattaggctataataaatgataaacattaaagtcagatccttaagaggga

SEQ ID NO: 57910 - DNA, 2550 bp, Homo sapiens
ggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatccttcctccgatttctaagggtccagtttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttctttgggcttggattaatattcatagtagaactttataaaacgtgtttgtattgtaggtggtgtttgtattatgcttatgactatgtatggtttgaaaatattttcattatacatgaaattcaactttccaaataaaagttctactt

SEQ ID NO: 57911 - DNA, 2497 bp, Homo sapiens
ggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatccttcctccgatttctaagggtccagtttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttctttgggcttggattaatattcatagtagaactttataaaacgtgtttgtattgtaggtggtgtttgtattatgcttatgactatgtatggtttgaaaatattttcattatacatgaaattcaactttccaaataaaagttctactt

SEQ ID NO: 57912 - DNA, 407 bp, Homo sapiens
aaaaaattagccgggcatggtagcaggcgcctgtaatcccagctactccggaggctgaggcacaagaatcacttgaatctgggaggccagagctgcagtgagccaagaccgccccattgtactccagcctgggcaacaagagcgaaactctgttaaaaaaaaaacaaaaaaagttggggggggggcggttctcagatgaaataaacttgggaaatgacagattaaacaaagtttaacaggtttatttgttgcagggcctctctgagcctttaaaaatgctgacagcgtggccaggcacggtggctcaggcctataatcccagcacttcgggaggccgaggtgggatgattatcggaggtcaggagttcgagaccatcttggccaatatggtgaaatcccatctctac

SEQ ID NO: 57913 - DNA, 230 bp, Homo sapiens
atcaacgaatggacaacaccaacaccgacacactaaaagggcacacactaccaaatcgtggcggtgatggttctataactgtatatggttgtcagaactcatcaaactgtaaactttaaaggagtgaatttaatatggtatatataagttatttctcggtaaatttgacttttaaaaacatctcttgtgttcatctcttatcccagtggcacagaaatatttctacatta

SEQ ID NO: 57914 - DNA, 459 bp, Homo sapiens
atgcttgcagtttcaagtaacaacagaatgctaagctgtgtcatgaacaatgagtaaaatttatcatctcacatgagaagaggtatttctaggataggctaagtcagtagcacagttgcctcatgtgtttcccatctttctgttctggagtggaattttgtagtgatgcagagatttattcttcctgccaaatctctagcctactagtgtgggtgtaagatttttctgggcctcatttaaagcctgcatatattccccaagtgctttaccagccagggtcagccttgccactatgccatgtttttttgggcgccagaattggcttgttatgttgaaagtattattttctctcatgatatttttctcctttagtacgcttcactattgaaatgcctgtaggcccagcttcccaggagtttgaggccagcctgtgcaatatagtaagaccctgtctccaaa

SEQ ID NO: 57915 - DNA, 338 bp, Homo sapiens
ctctcttgtgtctttatccggtattagcgtctgaaagaagaggtgatgaaccggaggacgtaagaagtacttcagtctatgcaggcatggtctgttgtacaacccaccttgtggtgttcgtgattgtacgtgggcagacccaggtttggcaggctctgacagtgatatttcttttctggctggggtttccatgacagagagccaaggaactttctctaagggagtttcagactgtgggctgggagagcagcttggagaggacagagctgagatatccataggcatgtcacggttctgtacatcattctgggtaaagtcaggcctgtctcctggtaagt

SEQ ID NO: 57916 - DNA, 252 bp, Homo sapiens
tgtggacacagctattacatttaggcctggagaagtgcagggaagaagttgggtttattaaaacatccaaagcttagatgaagacctcatgtagattaactcagaatatctgatcaggaggccttttcaactgccaagaattacagtgaaggggagaatagcgcagttctggagtgctcaaggcagatagagactgcaacaaaccactgctgctatgggcattattgtatgaacagtgtgaaaacaggaaag

SEQ ID NO: 57917 - DNA, 550 bp, Homo sapiens
  misc_feature (358)..(358): n is a, c, g, or t
  misc_feature (452)..(452): n is a, c, g, or t
  misc_feature (469)..(469): n is a, c, g, or t
  misc_feature (500)..(500): n is a, c, g, or t
tcttgcctcggcttcgtgagtagctgggattataggcgcccgccaccacgcctggctaattttttgtatttttagttgggacggcgtttcaccgtgttggccaggctggtctcaaattcctgatcccccgtgatgtgccccgctcggcctcccaaagtgctgggatgacaagcatgagccacctcgcccgaccacgtgtcatttttcttcttgcattcacaagagatgggctctgtggtctgtggaatgaaatggttaaagatggagaaattgtatacactggaacagaatcaacccagaacggatagctccctcctggaaaagtagagacgaggtttcaccgtgttaagccagggtngtgttcgatattcctgacctcctgattccacccgccatgggtttcccaaagttgttggggatttacaggcatggagccaccaaggcccggccantatatttggtttctttnttgaaaaattattattgggtctgtttacagntgattagttttcggaaccaagtggggacaaaggaaagttttgaattgaca

SEQ ID NO: 57918 - DNA, 453 bp, Homo sapiens
tgggtggatcacctgaggtcaggagttcgagaccagtttgaccaacatggtgagattccatctctactaaaaatacaaaaattagctgggcatggtggtgcacgcctgtaattccagctactcgggaggctgaggcacgagaatcacttgaacccaggaggtggaggttgcagtgagccaagatcgtgccacccgcattcagcctgggtgacacgtcaagactgtctcaaaaataaataaataaaaaaaaataaaatggctaattttttatgtgcatatcacctcaaaaaaaagacaaaaaggaaaaaaatagcctttagtggggaaaaaaaccatcagaacaatagctgcctggaagagcgtaggggattgactgggaagggacacaggggaactttttggactgatggcagtgtcctagagaaatataacataggccacatatgtgatttg

SEQ ID NO: 57919 - DNA, 433 bp, Homo sapiens
tttctaccaaatgttaaagctagtaactgataaattgttttacctctggttattgtgatgttagcaaagaataaccagatgttatgatatgtagcagacatgtcctttattcattgattctgttaattatttgataagattgatgtgaaagctttttttgatggcttcaaaacaggaccagtgaaaaaaagactctagttttagtttgagttttctgggtttttaactagtggggctgagtttattaaatgcttccccaccccccccaatagtacttttatttataaagcagaattgtcttctggcaagtgttggaagcataattcatatgcatataagtttgatagccttagaaaggtagttttgttgttaaactaagtaggatatgcaagttagaatttttttccactccctacttaggttgatgagtctg

SEQ ID NO: 57920 - DNA, 436 bp, Homo sapiens
tcaatctagaccttgagactaactgggagacagctggtgctgcagagtcacacactggctctgtgcctccagcaagccgtgtgctctgtctcccctgcttcccgccacatggagtgcagaagggaactcattcattattttaaatacaaaaaaagtaatacatgcttattgtaatagattcatgcaattcagaaaatgtaagaagtgaataacccctagaggtaatagtaacagtttggtgtgtatcctttcagacacagtgatattaatatatgtttgtgtacacatcaatatatacccacctttttaaaaagtaaggaatatatttacctattctgctctgtcttttaggttacttaatgtcttttcatgtcagtacataggggatctccttccttgttttcagtggtgtgcacgatttctttgtatttagcca

SEQ ID NO: 57921 - DNA, 502 bp, Homo sapiens
ttcctgaaccattccttacaggtagaagatactggaagatcaactctaatttgtggctgccttcccagcagtctctacttcagcatatctgggagccagaagcactcaagtttgataactcaaaagacagaacaatcagtcaagggtgggttggtttatttttgttcacgggtgttcatgtgcattcccaaacaaaatgagggtgaagagagaggaagtgtggaaaagataatggctttcagatttccacagcaccttttgcctggaccacttttcagcatttagtggtggggtttcagtttctaatacacagagcaatcacccaggcttttcccacagctaaggctttgagagatgaagtgacgtccaagcacagtatataatcaagtggtcaaggctgacacatggagtaaagctgtgattcagtctttccacctaaaattgtatgacccaactctccaacttaaatagacctttgaatatatctccagagaataagtga

SEQ ID NO: 57922 - DNA, 357 bp, Homo sapiens
ttcctgaaccattccttacaggtagaagatactggaagatcaactctaatttgtggctgccttcccagcagtctctacttcagcatatctgggagccagaagcactcaagtttgataactcaaaagacagaacaatcagtcaaggggtagaggctaccttccattctgctcatcttacacttcttggaaaggagacattcggtgaagatcactactattctccaaacttcattcgggaccctattccttccctgttgatgtcagtgtgtgaaattctaaattatgtcatgggtgtatacgttcaaaagcaatatattttcaaataaacaaaaaatataattggccatcacatatacc

SEQ ID NO: 57923 - DNA, 361 bp, Homo sapiens
ccccgctctactcatcactgatcatgtttcttacggactcaaacttgaaaagctgactctactccctgaatattatccatctgttaagcagcatcaaattagagacaaaccccatcttctcacttttgggggctgaactgtaccgtccctcacaattattatgtcgaagtcttaaccccagtacctcataaagtgactgtatttggaggcaatttaagttaaaattaggtcatgagggtggccctaatccaatctgactcatgtcaagccaagagaagcctgagaacaaaccaaccctgccaacaccttgatctcagactttgggcctccagagctgtgagaaaataaatgtctgctgttt

SEQ ID NO: 57924 - DNA, 327 bp, Homo sapiens
agtctattaggtacacaaatagaaatgttgaaaagatagtttggaatgcatgttttgagtttggaagggtatttaggctagaatatctagatttgagagctgttggcatggctctgtcttagtcaaatttgtcttagtatgttttatgctgctataacaaaacccttgagactgggtaatttataaagaacagaaatttatttcctcacagtctgttggctgggaagtttaagatcacagtgccaggaggtctggttgtctggtgcaggctgctctctgcttccaagatggcaccttgttgctgtgtcctccagaagggaggatccc

SEQ ID NO: 57925 - DNA, 404 bp, Homo sapiens
cattaatattctcagtgttggaaatatttttatattgccaagaccataatgtgaggagtgcagctgcataaatccctgagagaagattagtggggctagcaccttacaaggaaagacaagcttgttggctgggcccaaggacagtcaaatgtctgcctgacaatctccacacagaagggttgctcagatcacttaggacacccagaaagagctcacaaagggcaaacaacctaaggctgatattctccattagcggtacttacctgggaactgagtggcagtggacaggaagcagggcctgggctagggagaccctcaggaggaaggggacccaagaagttagaagtccattcattcatatactcattcattcagcaaacatgcgctgacaccttctgtatgct

SEQ ID NO: 57926 - DNA, 440 bp, Homo sapiens
acatgaatcagcttcacccacagtgtctgcatgtctctgtccatagcaaacgtttttattaccttaaaatatagatttttaccttaactagccaagacctaggaccctttttccaagctcttttagatgaagtaataaatgcaaatattagagatgtgtatatgtgtataaatatatggagaaaagatgttgcctagttgtacaaattagctttaataaaactcctgatttaaattatttaattgtgagaagggagattctaactcaacacgccaacgaaataaaagccttatccctctgctccgccaaaatatcccatttagagcctgcgtgtgtgtgtacacacacgtgtgcactcatccccacctgaccatatcaaattattatttaaactagatatttttactttgttgcatagtagtaatggtttctggaatgaa

SEQ ID NO: 57927 - DNA, 1039 bp, Homo sapiens
ctgcatgaaaattacaattttcctgtctatcccctcctggatccagaagtgttttttccagagtgcgacacttcccagaatccactggagagccagcccaaagggcatatcaggatgggacaaattacattctggaaaagctgccttggtgattccaatagtcctcccacccaggtgagacccactgcccagaagtggggttcctgggttagcatgatatctcatctgtcaccacatctcagcatccagcagaggccgagtgctggaaaaagggtgtgggaagagattgagttcacacggctcacctgctcattgcattaagagtatttcagaacagagtttttcagtgggggcagagagcatgcccctgcctcaggtgaaagtcttgggcatgagcctgtcacctaccaaatcaccatgagacagcatgtgaccttgcggatggccggggttcggaagaggtccaagattgagttggaggtgcagacacttgcaaactcgctttggatgtaggagctcatcacctaggtaagaagactctgctcagggaaagcgagggagctcggaccccacatccctgctgggaaccccttcgtctgtgtggaggagagctggggttgaggtctttggtgaggtggctggcccttgtctccgctccgtccaaggactgatggcacttgaggggtgttgagaagtgccaacacactgtttccagggtgttgagaagctccaacacgaactccaacactactgaggttctgcggttctggagggcctcccaccccattcctggtatagactcggagattgagtcagataagagcaggggttccaagtggttctgccacttcctactgtgtgttctcaggcaagttacccgtcctgtccccacttcaatttcctctttgtcaaaaatgagacatgaaatgagattacatacataaagctctcagcctagtgcccggcatggggcttgagaaatgatgcttattgataataaatggtaactatcttataataaatggtatttataatggtg

SEQ ID NO: 57928 - DNA, 2140 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57929 - DNA, 397 bp, Homo sapiens
gcctactactactaaattcgcggccgcgtcgaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57930 - DNA, 2084 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaactataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57931 - DNA, 2121 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57932 - DNA, 1791 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaatgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57933 - DNA, 1415 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57934 - DNA, 2314 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtgagtgtggtcccggggagcggcgccccttcccggctcgggcggcaaacaggaggtggggctgggcggccagctggggcgcgcagctgccggtcgcccccatgaccccggggcccgcgtgtggcctcctgcggccacaggagtgagcctggcacacctgatgaggaggaggaggtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57935 - DNA, 1832 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaagg

SEQ ID NO: 57936 - DNA, 1436 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagatacaatgtggaattcaaggagatctgaagtggtccacagatctccttgaattcccagcattgttatctttgtagttgag

SEQ ID NO: 57937 - DNA, 845 bp, Homo sapiens
ccctttttccgtccgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagaaaatgaatgtgattctgctctgtctttttaagtatgatcaaataaaaaatttgtacatcacaatcatttctaccaaaaaaaaaagg

SEQ ID NO: 57938 - DNA, 264 bp, Homo sapiens
agtatcggcggaattccggctgtgtagagggaaggttaatggttgaaaagcagggtacctcacaattgaccctcaggagacaagcatggactgtggagttaggccaatccgggttcaaacccaggctccagctcatacttactctgtgacttcccttggctgaagttcagtcccaataatagtacaggttgagcatccctaatccgaaaatgcatgatctactccaacactggaaactttttgaccaccaacattacaatccaa

SEQ ID NO: 57939 - DNA, 328 bp, Homo sapiens
tctgctgattcctcatggaatcccctgcctccaatcatctcctcctctacctaattctagatgtcactgcctgagtgagtaatcttcgaaaatgtagatttaataataggggatggggaagcctctcattgtttaaattaaaaaaacattaatattcaatactctctataacttttctttctggcttcagcttccactctatctcttcactccaaccaaattaaatatgttgtttgtagtaggaagaatgaaacctttccctcccctgaccccctgaccgatgatgtccacatcctatttcccagaacctgtgactctgttacttaca

SEQ ID NO: 57940 - DNA, 338 bp, Homo sapiens
ggctgtcatgagaatcacttgaacccgggaggcggaggttgcagtgagctgagatcatggcactgcaccctagcctaggtgacacagcacaaaaaaaaacaatgttccacaagtcaaaaattgtgttcagggagtagaaaagtagtaggctaggtatcaaagggtatgaatgactaagttccttctataatatattgactataggtaggagatacactttcagttctgttttggtagatctccaatgatctgtcatttaagagtacacacgatgagtggaaaatttataatcaaagatttcacagttgctatgcagttcaaagattcatcctttgaat

SEQ ID NO: 57941 - DNA, 568 bp, Homo sapiens
ttcccatatcactcattctttaaccactggaaatttggtataactagcagaacatctgcctccctcaggtgagagacttgtttcataacttttctttatttacttctacattgtcttcaatggtaatggaagatacaaggttaatttgtttgttcatccatgcaaccatttgttcattcaattaaacctgtatcattatataattagcctgttccaggcattatactgagctctgggaatacaaagggaaagccaattatattttattacagtgggatgaactgttacatattttgcattgtagtgaagtgggaacaatgtgaataattacagttcaaagcccatgattgtgagattgatgttgatgaatgaactaaacatttcaagattttttcccaagaattttcatgtcagcaatgtgcaaattgggtgaactttaacaaaaagagctttaatactggcaaatggaaattttggattttaaatatctaaaatgcacatggaattttagagctggaaggatccttagaggtcagctaattcaactcattttacagatgaagaaacc

SEQ ID NO: 57942 - DNA, 273 bp, Homo sapiens
aggccataattcctcagccttctctttttggccaatctgggcatcctttactggggtgctttggtcttacctctgtgtctagggatcctttagcacccactcagcagcagagattcctacctggcccaggtctcttgagaccccttctgtggtagaaagctaagtagcatttattagtcccagctgcctccctctaggaactaaatggttaagcaccagccccaaactatatggttcagatgtgtgcatttggagagctgggatacaaaagaa

SEQ ID NO: 57943 - DNA, 804 bp, Homo sapiens
actcacctaaggatgcgagctagcaggtcttgcagcggctatcacgcccctcacgccgctatctctgtgcagccgactgaggatccctagtcgcataaggctgtgcctggcctgttggcgtccctggcagttgttgggttctggcggttgttgggtccctggcagttgttggcggttgttgggttccttcattgaaactgcactaactgggcttccagtcagcgtcagtcagcggatccttgggccgtggggcagccgcaggtcggttaggccaccagggcggctctcgtgccagtgaggcccctgagagccctttggtcagacagaggctaaatctgaacagtcaggcggtgagattaagcatagtcagggagttcgccaggagccagcgttcctcagcctccaccacgtcagtcacctggtcagccagagggcagctggggcgacatccatctaccaagaaggtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctgggtaagtaaggaaagagttctttggctgcccaggccttcgtgaaagggctgatccagggtgctatctatgcgggaattgtaattgcgctgctcttcctctgcctcctccctctcatgtgagtactaggg

SEQ ID NO: 57944 - DNA, 316 bp, Homo sapiens
atccagaacagctgttggggaaacagggtaagttcagattgttgtcgggagggagggcacaaggaacttaccaactccttgtcatcgcattcctggtcacctcgctaagagaataaaggattgtaaagggtagagtgtaggggagagagacactgttagttctagatcaagatgggcactggcagatgctaacttacgtacatttttaaaaacgcaagcctaactctcaatgcactgtgaatccaggtgagatccgaaggcaaaccatccctgttttaatgttagccaggttttggattggctgccctctcccttc

SEQ ID NO: 57945 - DNA, 1894 bp, Homo sapiens
ggcaaaatgaaaaaaaaaaaaaaaaaagcaagggctgatttttattcttctattcaaaatacaaggacagatgcttctctgttccaagagggtttccttgaggaagctactgaagcagaaagacatgatggagacgagatcgcctcccctcttgtcaaagtgttaaaaaaatgttctgtcttactctgcgcctagcattggaaatgaaagtgacatttacgccacaacccacgtgtgcgcctcctctctttttgtttaaggatgatcaggtctatccaggaaacagctctggcatcccaaactgaaataattaggacgtatatagacctgacaaaaatggaaagggggtggggaatctgagggtctgtcttgcctaattgattccgctaaacggaatgcaggagatgtgaacggcaggacgctccgattcccacgctcgggggcaagtgataaagcggggccgggcagcctatgacagacagccctgttggggggtgggggtatgaaaaaaacatcaagtgcacacaccatactcatctccatcgcttaagaaagtaaaggcatttcccacccacagccatctgcagcttcccaaatggcagcaccaactggtctgtagctgctacatagtctgcttctgttaattttttaaccactgtttaatctggccataattaagtttggctttcttcgttgtttgagattttcagaattcaaggcaagctagtagaaagcaattccaagaaagtcccatgactgcctgcccctaatgtcaaaatctcagtccatgagattatggccttgtgaccacatttttgcttttgttttgggtgggcaaatgtgtatagagataaaatacatatctctatataacagtcgttattataatttcatgaggctttttacctcttaacatgatacatctaggaacttggtctaattgtgctagtagatatacactagaagtaaaactataaagtcattagcctgtagaaagttgattatgataacaatatgataaaaagtttgttttggaatagtctcagctagatgggtctaaatagccattttaatgtaatctaaaaataacactatgcctagcagaaactttggcgctttggaggtccccattgtcgccttttcataaaagtccttaagttttccatatgtcaccaagcaaacatttgtataggcatttacacagaaatataaccattgcaattagaaaatatccaaaatagcctgttatcttccacgtggcctagattattgacaatcccaaatatacaatttttctttaaaagtagtacaatttcctttgtagcttcaattccttatatgacttcagactggagaagcctgttaaaccactgttagtttcagttagaaagtctgagagactttatacataaattctcaatttggctgctgtacacgtgccagagttttactactgtagtgaccgttgagaagacccttgtttatttacatttgaagcactgtttgtgcaaacaacctttcattgttaagtgcctgtattcctttcatttacttcatgtccaggggtgctatttacctagaaccattgtctactacaattaacatttacattacaaagtgtgtggttttctttttcaaggaggttcaattaaggcaataagatgtttgctggagaaacctattgtttactgaaagcactcaatgaagtcaaattactgaagcttttgcctacatcttggtcttttatgtaaatatgttaaatataacatctaaggaaaataaacaatattataattatgtgtttgccattgtcatatcaaacttgctttgtatcatactaatgttacataacttatcgatcaataaaaatacatttcaatgttaaaattttcat

SEQ ID NO: 57946 - DNA, 568 bp, Homo sapiens
ggcaaaatgaaaaaaaaaaaaaaaaaagcaagggctgatttttattcttctattcaaaatacaaggacagatgcttctctgttccaagagggtttccttgaggaagctactgaagcagaaagacatgatggagacgagatcgcctcccctcttgtcaaagtgttaaaaaaatgttctgtcttactctgcgcctagcattggaaatgaaagtgacatttacgccacaacccacgtgtgcgcctcctctctttttgtttaaggatgatcaggtctatccaggaaacagctctggcatcccaaactgaaataattaggacgtatatagacctgacaaaaatggaaagggggtggggaatctgagggtctgtcttgcctaattgattccgctaaacggaatgcaggagatgtgaacggcaggacgctccgattcccacgctcgggggcaagtgataaagcggggccgggcagcctatgacagacagccctgttgggttggctggggttcacattcgacttggggctaaatctacagtaggttccatctcaaactggacctaatggataattg

SEQ ID NO: 57947 - DNA, 687 bp, Homo sapiens
caggtttgtgtcttcaacaaaatcccttcataattgtttcttttgcttcagacgagagaaaaagtcgacacctgctttccttctgccatcgtcgctgggaagtgtcctcttgtccatctcctgtccagaggcgccttcctgctgtgccccccggaatatggctctttctgattttaccagcccttttcacatcactgcacccaggggaaacgtcctctccccagcctcctaaagtgtggccatgctatctccttcctgagacactttcctctggagattgccctgctgtgatagcctagtcattgccatcccggacactcatggtaccctgtacccgaaccaaatcagagcactttgacacaaggcagcctccaggcaggggtcaccctgggattgtaagatccatgtcactccaacagagcctcttccttccctctcactggtttctgccaacagagggcggccaggcaccacgcccatatgccttgaatctgagctaaccaccatgtaggatctaagaaaaatatgcttaccagatgatgttggccaggcgcagtggctcacgcctgtagtcccagcattttgggaggccaaagccggcgatcacttgaggtcaggagttggagaccagcctggccaacatggtgaaaccctccgtctactaaaaaaaaaaagtgccgcttcaaa

SEQ ID NO: 57948 - DNA, 738 bp, Homo sapiens
acaatcatttcctttattcaataaaatattgtgtgccgggctcagtgctagttttccatatcgtaaacacagaggctccaaatggcaggccccatcaccttatgagagttgattgggcaagttctgcagtctgtcttgcagggcctcataataatttttcaccctctgcttataggctctttttcctgacttttggggaagacttttcaggctccttccagagctacttcagttttgggggattctagctgctagaagacatcaaaacttttggggatgtccaggccaaggcagctcctgcactggctgctgtaggcatcactgctcaggccctctgccaaagaccagataagaggaataagcgacgcccattgtcctagagtcaggccttcctctggtggggggtggggaggccgtttcagccctctaattcccattttccatctgttgcttcaagaggatcttcttctgaggttgtaggtcaggatgaagcatttggagtgtgagctctgagggtaaaggtggcagagtaggagaggcccatttgtgtcttcacagtgcagccacattcattcttaacgcaccactttccaggaattggttctctgctttaaatggctagaaactgaattttttaaagaatattttaacatcttttaagatgtagttcgtctagtccaggtcagacctggcacaggcccaagtccctcaaaagacatttctcttttgataggctcc

SEQ ID NO: 57949 - DNA, 406 bp, Homo sapiens
gtaagtccaccttactaaagctcaaagaaatatcctataaaatctgctttttaaaataaatcgtcctttctctgccatcgtggtgtgtgcttgactgcgcttctcgccatgtcttctcacaagacttttagggttaaaagacttttaggattcctggccaagaaacaaaagcaaaatcatcccattccccagtggatttagacgaaaactggtaataaagtcaggtgaaactccaaaaggagacattggaaaagaaccaagctgggtctatgaggaattgcacatgagatggcacacatatttatgctgtctgaaggtcacaatcatgttaccatatcaagctgaaaatgtcaccactatctggagagttggacatgttttgttgggaatatatatttttttctct

SEQ ID NO: 57950 - DNA, 202 bp, Homo sapiens
ttctggcaccacattcaatactgattcacagggatctaaaacattctagttattcagtcactctgtcctgtgtggcagataggacttatgtatcttcagaatatttgaggagtcattctcagagtctctcatgagtgctcaacttaactgttccacaagtctgtcttcatagctgcatgttgcatcttccagtctctgttct

SEQ ID NO: 57951 - DNA, 544 bp, Homo sapiens
atggactgatgggtcaaatggtagctctggtttaagtttttccatctttctttttgcagatgagggatttgagactaagaggttcagttacattcctgagatcctgtagaacgtgtaccttcaacagggctagaactcaggtctcctggcccttgccccaggacctctcctttctcccatgcagaccttccctatttcaatgaagggaagggacccatttggataaaagccactgaaacagccttgaggagggcaggtttttagatgcatatattcatgcagtaggtgaaagtgtgacatcatatatctgagaaataataatgaagtgcattcatgaactgagtcatttagatagctaatccattgaggcctcttctctcaaatcagatgatataccactcaaaatcatttcttttgttgaatgtcatttcccataacttcttgtcctgtttgcatattgataaatgtattcttaggtctcacaacattgtaattcttttggcactctctcaatctttaaaacttacatatgggtgagtaaaat

SEQ ID NO: 57952 - DNA, 398 bp, Homo sapiens
ctacactcaatatcttactttaaataaaaaatggtaaagaaaaatagtaggcaatcacaaaagaagtttgagagtgggagtatgtgtgggtaggtggtagagattaatgagcatggaaggccgcgaaggttcactcagaaaatactttatgcagcaaagtgggagtcatgctcagggtcacagaaataaaaacattttctgtgaactggcctcacaagaatgagagctcggaatgtgtgtggtagtggctgagaaagtgggtgtccagttttgatccatttgtcatagtctccaagacagcatgaggccgtttaccatcatcttcctgcaaatgtccttcataggctgtgggttttttttccttcccttcttccttctcttcttccttccttcctctc

SEQ ID NO: 57953 - DNA, 400 bp, Homo sapiens
gtactagccatcagtattaccttaggaccacaccacgaatgtcaatgaataaatgcactgtcttttctccagggagattttacctgacccttccagatctggggtaggtgtcccagctgggtttggtaatagatgctctcacacactcttgcgttcctttcataattctcatcagatttgtaactatttaatatctagatttcctccaaaaactataatttccatggaggtaaaaactaagtcagtcttgtttgtggatttagctttagggcctacacataaatatttgtttgaatgaataaatgaatgagcaggggccaatactatttttaaaggagtttgaactttgtcttgtaggcaaccagaacccaaagcaaaacaacttgaagaaagttgtgtc

SEQ ID NO: 57954 - DNA, 325 bp, Homo sapiens
gtagtcattcataaacagataatgctaggaccatatcgcagggttgttatgagaatcagcctataaaatgcttagcacagtgcctggtacataagaagtgctcaataaatgttagccaagccaatgccactgcagtgccattgaagttgtgtgagtcagatgaccatctgcctttattgtctgggaagtgaatttaatttcttctgtgaagtgggacacagtaccatagtagctctgtgagtagctgtgattcaaacctgagtttagagggaaacacttatttcacccacagccacctcttttgcttattcccatgctaacccat

SEQ ID NO: 57955 - DNA, 571 bp, Homo sapiens
ctttagattatgaatggagagctacatcccatggggtggcagatgaagatgtgcaagaagaagacactaacaactgaattgcagattgaggagatgagattatggtgacagaatccatcttcggtgtatgtgcatgaagaaataagccaaatctacatctataaaaccgcgggaaggaatgagataataatcagttgcaggtctgcttagattttaatcgtttagtgtagttcgtggcagggtctgataccctatttcaatagtggagagaattagaaagcattttcttttttcatatctactattattggttatataaaagaagtatcaaatggtttctgctttcatggaatatactgtccagtcgcaaaggaaagaagatggagagatgattaaaaaaaaaaaaaagaacaaacagcttccattattctagcaatgcccacacacccctattgtttgagcagagaaaacgctgacaggggactggccaggtaaggaggaacagaccacgtggccattatgctcttgccttcccacctgaaacttctgtctccttatggctctccctgag

SEQ ID NO: 57956 - DNA, 990 bp, Homo sapiens
ggagaatgtatttgagaacaactcttccagcttcttacatatgtacaggtatctctcaggggctgacctaggaagggtcctttcctgtggccatgatcgatccagtcccacatctggaaagcttacaagaatgggttcaaagcggggattacacttgataattacagaaggaccacctacttcttagaggaaagacgctgggaggttgcttaggatgtgggccaagagggtcagagaggaccacctactttttagaggaaagacgctgggaggttgcttaggatgtgggccaagagggtcagagattttgcttcacctgaactcactggggcttctccagggatattaacctggactttaagagtcagagtgagtccctgggactagttcagcccatccaggattcagacgggaagaaggtggggctgatttttcacctggagaaagagaggcatgtcccacacagacctaactcggcattgtcccctcccaaactcccacccctccacatagcttaaaagtgttgggggcttctccagtttagatgggggaacaaagagaaccaacagctggaaaaaactagagatgaggccgttggcctagtcatcatccaggccgatttctcagaaccaccactttctcttcggctactttgcccatcccataaaagaaccccaaatccttcctgttcattcctcagcagttcccacgtttccttccagaaactcagaaggcaccaggaactgaattgcaaagttcgttagagcacagactctgaattaaagagctgggttaaactccaggctattcccttaaaaaaaaacaagaacaaaaaaggggggcgccaaaaacccgaggggcaatgcggccccttttggacaaggggcataggggagaaaacgagcacgggcgaaacgcggggaagctcggatgaaaccactgggggcaggcccccgaaaccggagaagggagggccgacgggagcgataa

SEQ ID NO: 57957 - DNA, 204 bp, Homo sapiens
gggactaaagaaaggtctgtcttgcctgatgccaccactgctagtgcccgaggatcagcccacctaatgttcctgtccccagcaaagccttacaacagcatccattaaaaaccacagtctaagacacttcagaacttaacaacacaactgatgctgattacagctgaagaaattgtacagagagtacactgctttactcaccca

SEQ ID NO: 57958 - DNA, 502 bp, Homo sapiens
cctcaaaaaataaataaataaataataaaaataaagccagattgtaaatatgcagtttaagccctgagccaggacaggctatggtgttctcatccgccaaagctatgctatgtagacctacaccctgtctctcccctcttccaggaaccctctcagcttttccagtaattttctgggggaaatgagaatattctttttattctaatgttttaacataaagtggtaataaacaggctacgcaacgaaaacaagaaactaccacccaatagtagccttctgcaaagaatcacttccattgttctggaaacccccatttctcggaagcaggcagtttttcacatcatgtgctgtgttatgacatctacatctggtttgcatgcagacatcactgccgtcagccattagcatgtattaagtatctgttgggtgcagggcactgtgctcagtggcatggggaaggaattgggaggctttagatgacttttcaaacattaaaattaaa

SEQ ID NO: 57959 - DNA, 446 bp, Homo sapiens
ttaagcctgaaacacagctctctctatagaatttatctatatgtggtgtgtcatagtctattatgggtttgtgtggggctggatcagattaataccctggatccaagtcatctttccaaatgaatccaaatgaaaatattggcttggagaagatttcttggtaatgaatataatgcagaataatgaacagtagccaaaaagagagaggatgtagaaccaatcaaaggaagggcagatgtttaaaatgtcttttgctgtttgagactgtgagccaacaaaggtaattatgtctgtgctttctcaatttccacacaggagagaggcactttgaggttttccaagctctcgtcctatctatgctttgggcgctgaacagggaggggaccgtgatgccatgcatggccaacagcaacggatgccaagcaaggctcatggcataagacaga

SEQ ID NO: 57960 - DNA, 321 bp, Homo sapiens
agagatcacaatttccaactgggtaaacagcttgaaaaaagaaacagaagcctgggcacaaatgaaaattccatattaattggaagttaagattcatatagagacaatgaaaggttaggttagaacaataaactgagaagtacgaatgtggacttcaggaggctaggggaaattacgaagtcataaaaagttcacagagatacttgagtacaaaagatacattattaaaatttctgcagaagtttcatcttatttgtgtgtgatggtttggaatataacaagccagttaggcgtataagcttatagtggctaatatgagga

SEQ ID NO: 57961 - DNA, 346 bp, Homo sapiens
cagagtgccactggtgtctagcagacagaggccagagactctgctaaacatcctacaatgcaaagaacagtccccctgacaaaggattatcccaccccaaatatcaagaatgctgacacggaggttgagaagcctggcatttccccattgctgcctctgggaggctgcctctcgggatagattgaattgttctgcaaagacatggtcggcagacacagagggttccctcaccaggggtctgggagttgctggaaatggataagaaaatcctagttctacctcgcagacagggaggaagtgaagaggtgaggcagtaaaaattcataacatatctatcacaaatgca

SEQ ID NO: 57962 - DNA, 307 bp, Homo sapiens
  misc_feature (242)..(242): n is a, c, g, or t
atcagcattaggttttcaccaaagtgatacaagtctgaaggtcttcatcagcagtctccctcatagtcagcgccataccgaagaggcctgtccctctcatagggccttccagccactccttccccacaggcctgattcttctgtggctgggagtgtggactgatttgttatgatgtgagagatccctaggggtgtgagctaccgcacctggctgaactttcaaggagaagtttgtgcatcanttttcaaaaaattatgatatcaaaagatagctgtgccctacatttgggaaagatacaaaaacttg

SEQ ID NO: 57963 - DNA, 254 bp, Homo sapiens
gatgcctctgggggagggaaattgggtagctgggactgaaaataaagataaacaggagacttatgtttcagtctatatcttttgaatttccctcccccagaggcatcctttgtgtgtgcaaccttatgtatgtgcagatgtacatttcatttttctcataattgtcatacactatataattatctatatattgcatttatcactttattataaacattggagataactattaaaataccaaacatgcctcaaac

SEQ ID NO: 57964 - DNA, 443 bp, Homo sapiens
cctcaacctcgttcagtttccacataatacctggggcagggatgtaaataccctgattttatgtgtcaggccttcaaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgtaaacactgaattctataaactgttggagacagattctggagagacactcaggcttagctctagaaagaaacgggtaagacagaggaggttcagggcaactgtgttgccttccttgactggtgcatgggaattccccagcagagagaaaaaaaaaaaagaaagga

SEQ ID NO: 57965 - DNA, 1047 bp, Homo sapiens
tcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacaacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaattttgtgtaaacctagagagccaagtgtcttactgctgcctcagaaatacttagagtaatgctatttcacaaacatatgggttttggtactgttgacttcttatttgtgtcccattaaaaactcatttaatattaccttgtttagctgactaatagcaaattaagaaagctattgtatacaagtgatatttggaaaaaaataattaaacttcttaattgagaatgatgagaaaatcatttcatatttagtgtagagttgcagtgctgtgataccttccaattctgaaagatgtcattaccatttgaagtagtctaaaacagtttagcaagcttatttgtactttatttttgctctttcttttcaagggatgtctctggtatcctcatgctttttatggattatagctgcaatctttcttaccagtatttttgaccgtgattcttaatagagttgtgtgcagccagcaagtttatgcagtctttcaaaaaaaaaaaaaaaactaaaa

SEQ ID NO: 57966 - DNA, 574 bp, Homo sapiens
actggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctctt

SEQ ID NO: 57967 - DNA, 405 bp, Homo sapiens
gagctaggcaccaggcattctgtgaggccccaggagtttaagaaatgaattaaatattctcccctgccctctttgaactgactctaacgaggagacttaagaattattttgtaatctctagttatattttctgaatttcagagcttaaatattatacttcaacatgagtcacacctttatttatatgttggtttgtctcagctgtgttgtgggttggtggaaggagaccacacatacatacacacagagtacatacatgctgttgatgttacacacatactcacaccccacaaagtgaagctccatgctcattttgtttaacaaagactagagaggccttgcagacaacagctacctggagcaggaacaagtgaagcatgtttctgaaccatttctcaagtcaca

SEQ ID NO: 57968 - DNA, 712 bp, Homo sapiens
cctttcccctattgtaccattttgccattcagacattgcctctctacaggttcacatatgggaagcaaagttgcctgactccccttgcttcatttgaacatctggattaaagttactgtagcaaacacaagtcaatcaaacataagaagaaagctcagcatctcctttaagagggccagcatatatgaatttatttaaaacctttaagtgaccacattggtgcctcagttttcaggcattcattgagacttttctcctccttcctgacactggaatattttagtcatacatgtagttttaaagaccaaacctatacccactccttttcagtgctaaaaaaaagtaccaccaaaatgtaaacaaatggcactaaccaagcaagtcttgggagtaggggtgaggatgagtatagcagcatgaaagaaatgggtggaaaccagtgtttgtcaatgtcagcacgtactcttgattcctccccatctcagcaaatatagactttcacaattaatactgactttcagagataatagaagagcctccataagccaggtttgacctttattttctgtatgagtcatatgtactatgttgataataccaatacgttttatacatttttttgaagtttaactttctcttaatgactccattatcccaaaaatctgataaggatgtcatgccaccactccataaataaatttcacaaagataa

SEQ ID NO: 57969 - DNA, 252 bp, Homo sapiens
ggactataaaaagttgacaccagttgatttttgtgttgatggaagttttttatcttgatgttggtgatggttatagaaatttatatatgtgattaaatggcataaaattatacacacacagtaccaatgcctatttcctgcttttgatattgtactttttatacaagataaaaccactgggggaaactaggtgaagaacacctgacacattccaacagggcaatttcctgtaaatcaataatatttgaaaat

SEQ ID NO: 57970 - DNA, 292 bp, Homo sapiens
caagccaggaagtggctataccttgatcttggacttcccatcctccagaacagtgagcatatagatttatgttgcttaaggcactagactatggtgttttgctatagcagtccaattgactaatacaatagagaagacatctcttctcaattcaaaataaatgcctctacctgtgctttagatagattattctgcttcctcagaagccttgctcctccagacttgcccttcctttgcttaggattccaattttcaaaagtaggaaattatagaactgaagtcttttttatac

SEQ ID NO: 57971 - DNA, 336 bp, Homo sapiens
cggctcaaactcaagaggctcagggtgccccctcctaggtgctgcctggggtcggcctcctctcccaccctctggcagaggaggagcagcccccgtccacccagccatgtccagagcaggcaggaacggtgggggcctgtgcttgcacgtagaggtcaccggtctggggccagtgtgctcccgggagtgggggagactggggctgggccctccttacctgcatggggactgggctgggccctccttatctgcatgggccggaagcacatgttggtgagcacctccttccaggccagtgagtacttgtcatctccaaatgtttgggtcaggcttttc

SEQ ID NO: 57972 - DNA, 611 bp, Homo sapiens
ctgagcacctgctctgtgccaggcactgtgctaggtattggcaaataaatgcatacaaggcagactcagtccccatcttcatggagtttctattgagctgaagcatcaggagatgagatataagaataaacctgggaagccgtggactggaggaagtgggcctccccaagcccaaggcctgggcatgacttgagtatgtgggagtgtgaatcctgtgaaccaaagtgcaaggctgaggtgcccatggcagtcacaatgccacctctgccaactcgcccttctccagcatgaaaatgtcctcctgcttaagacagtttaccagtgttaaagtcctttggggaattcccctggacccagccattcctggggcttcccctcatcaaggcctttcccagggtttgcatcccatttgcctaaggacacctttgtcagccattcctgatcctctaatttgcatcactttccttaggatggaaaaattagcaaaggggaggaaactgctatgttgtctagttgggaacatttccaggcttttctaacccatctgcttataggcaatgtctgctcacagttcccatttctaataaatatttaccaaatttacatactgc

SEQ ID NO: 57973 - DNA, 240 bp, Homo sapiens
cttaaatgtcaccacctctacaaacttcctaaagaaatgtgaccttttccataaccctaatttattcaatatacgtgtaccattttgtgtctattttcattcatccaacaaataatcactgagttactactacatctcggaaactgtgtttggtttggggatacaaattatcatggctttccttatgtaacttacagtccattggggtattgacagaaaaatcatcaacaaattaattaa

SEQ ID NO: 57974 - DNA, 339 bp, Homo sapiens
attttcccgacaaagaaaactgggattcagagattttacagtttaaataactggcctggagtggatctgctattaggacatgggctggctgactccagcatctattttttagctgcttcctatggcttctactatgctctttactgataatcagattggaatctttttagttaatgagaatgatactttcaacatgtgaattttttcttcattgaatctttaagaatgaataaatcacttcttgatataatgaagaaaacatgtaatatacttctgatattttgataactggatattaaatatctctaccattgtgtagaaaggtagataatttgacat

SEQ ID NO: 57975 - DNA, 625 bp, Homo sapiens
agctacatattcccttaattttgtattgaaccaaaacaatggcaccagactagtgaaatgaggaccagcttcggagttagtttgagaggtttcagtcccagccttgctgttgactagctctgggacctgggccttaacatataagccttagttccctcatctctaaaatggagataataatacctacatgcagatacattgtgaggtctcagtgaaatagaatcatccagtgtggtgcctaaagagggttttgtttggtttgttcactgctgtatccccagcacctaggatggtacctggcacagagcaggtgcccactaagtgctaaaatgaatactgaatgaatgaatgactgtggtcagtaaatgatagctattgctaaaggcatggcagagctgtcagacacaagaagtgtttgtaaagcaagaggctgattattcagaggcttgaaggataatgctttgtcataagctaaattaatttttccccaccatacagcatggctttaggattcttcaaaaactaactacgttggtctgatggtagtgggttaccagaacttattaacattagtgtcactaaagttggcatataatccccctgtgctaaatttgactgccttaac

SEQ ID NO: 57976 - DNA, 151 bp, Homo sapiens
ataaactgtgctaactaaagtttttattttatcaatatcaaagctgtaaaaaaactgaggagaaagcagttgccaaaaagatgaaagaaaaacaacatgaaaacctttaaaattagcaaaagtcagtttataataaagtcacttatctcac

SEQ ID NO: 57977 - DNA, 785 bp, Homo sapiens
atcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggaggggg

SEQ ID NO: 57978 - DNA, 391 bp, Homo sapiens
gaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaagtgtgcgaaatatttgtgtaataaatccttcgtttgtgttcatttgttagaagcc

SEQ ID NO: 57979 - DNA, 532 bp, Homo sapiens
ggattgcctgaagtcctggaacactgcatcccacaggcttcctgctaaacgggaaagccacccaggatgactccatgggccccagtccttttctctgctcccctcctacagttcacatcacctcctcggcttctctttggggtcctcgccccacctctgcctagggtaaactcatggccatggggcacaggccagacatgaacctgcacagccctccctaagcctctgttacctgggagaagaagccccaagcagcccagaggagtttcacagaaagagctggagcgccgcatctgaagatgcaccacctcccacccagaaagaacgtgcaccccgagcctggacctccatggcggccctgcctcccacccagaaagaacgtgcaccccgagcctggacccccacagtagcccactcccagtgaccaggtcaggtttcagggcctgtgatctgaggtctggggtgggggtcatctggagggaaatccagccccgggagaggcactggtgagccaggaggaggcccagggtgc

SEQ ID NO: 57980 - DNA, 390 bp, Homo sapiens
tgactaaagtgcccagcacagagcctggtgcccagtcagcatccaagtagggtttgttgttgccttacttgttttttatactttattatacatcgtgagcattttctcaagttgctaaccattattcaaaaccatgatgtctcatggatatgtaacaacccacttttctcttaagatttaaataatgtcattttggtcagttttgcaatttccagattggcaataacataaattccactgaactaaacattcttatgcagaagtctttgtgaccaagtaagatacatttctaaaatagaatgattggtcaaaatgtatacatattttaaaggctttcattttcattcatatgtccaaattccatccctgaaagattgtagccatttgaaa

SEQ ID NO: 57981 - DNA, 2780 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57982 - DNA, 2850 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagaggagatgtgaagatttttatcctgtgttgcagttcatctttgctccttcttctctcaccaggaagttggactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57983 - DNA, 1802 bp, Homo sapiens
cggggtggggagaggcgggtacgctcatagggcggcggggtgctgttggcgttggcaacggccccctgggacatggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57984 - DNA, 1426 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57985 - DNA, 1180 bp, Homo sapiens
ctctgcagggcccaggggcggagatagtttgctgtggtgtgggaatgtagaccaaaatccaccttggctagttcagaggggaggacttcagtggagggtttgatttcccactgagttgaagccaggcttgatttttttggcctggatagggtgatgagccttctgacaaaaggagaccaatctcttggagaccactgtgatcacaccctccctgtccccattggcatctccccaatgcccacctggagtcctcccctcaattgtctcattcaccaactgtcttcttctctcgactaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57986 - DNA, 928 bp, Homo sapiens
acccacgcgtcgcccacgcgtcgaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57987 - DNA, 686 bp, Homo sapiens
tttttttcaaaggaaagagcccaaaacagatttatttttctttaaataaagttcatacagaataggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57988 - DNA, 2573 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagaggagatgtgaagatttttatcctgtgttgcagttcatctttgctccttcttctctcaccaggaagttggactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagtagaggcacggcagtagggatactctaggaatcagctatcacgc

SEQ ID NO: 57989 - DNA, 2343 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagaggagatgtgaagatttttatcctgtgttgcagttcatctttgctccttcttctctcaccaggaagttggactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtactgtatgcccccccgcctctgcccccagctggggcttagggcaaggggctgaggttggcatgggagggaaactggaggcatcggcccctccctcggtcttctcttctctatttttgtgggatgtccagaggccgaggggagcagtgtctatgaactttcctggtcaccagggttcaggtggagcatagtgctcagcctggggtggtacctgctagtcaggccaggcacagtgtcacctgtctaggctagcccaagtgtcattggagctactgcctgcaggactgtggcccatatcctttcccactgtctcaaggatccttaagcctattacgtggttgtcctggctttggcagggatgtgggttaaagagtag

SEQ ID NO: 57990 - DNA, 1539 bp, Homo sapiens
gcggccgctcccacttcagattggtaaccactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 57991 - DNA, 2902 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagaggagatgtgaagatttttatcctgtgttgcagttcatctttgctccttcttctctcaccaggaagttggactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaaaaaatggtgttttaaaatgtcggccgcctggcccagcggattttagattgga

SEQ ID NO: 57992 - DNA, 2801 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagaggagatgtgaagatttttatcctgtgttgcagttcatctttgctccttcttctctcaccaggaagttggactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagtcacactggggagccggcca

SEQ ID NO: 57993 - DNA, 867 bp, Homo sapiens
atctcactctgttacccagactggagtgcagtgccgtgatcaaagctcactgcagcctgacctcttgggctcaagcaatcctcccacttcagcctccccaatagctgggaccactgacaaacgccaccatgtctggcctttttactttttgtagagatggggtttcaccatgtatagctgtcctttttatgtgtttgtgcaactatattagaaaatccagaataatggaatcataaaaatagcccacgttcagatatgctttataataatctgattaggataaatattatgtttatcaacacaattgtttatttgttaagaatgaaacactgtgctaaggctctgcagaaacatataacatgataaataccttgtattggggagacaaatgaagcgaatacaagtgagtctgaaaaacatggtactgtggaaacaatggtaagtaaacataccaggcaaactgtgtgggaataaaagtatctatttttaaagaaaaaaaaattagaggcccagcaaatttcaaatactatttagcatggggcagtttttttggatttataaattggattgaatctcaaaaattcattgaaatgatgtgtgatttatggaacaaactaaacatatggagcgtttgtagagtaaaggagtttcattttcagcagttgtagaagtcttgctgaggaggcgacttgtcgagcagcttgagattattatggatttttacagtaagagaaaattgtaggtaatagcctaatatggtctaatctcaactttaccagtccctgcctccataagagtataatagtttatgtgatggcttgaatgccagatgaccaggtccagtgtgtgtgagggtgtggtgagtga

SEQ ID NO: 57994 - DNA, 433 bp, Homo sapiens
ctggctttgcttccaccttcctgtgacctccaccccaccatgctcttgcactcccacagatggcctgaaatcccaggtggaagtggagggtgttacgtgatccccaactcccttgagtggaaacaccaagtttcctagaggacctaggagatgttctttccagccaccctatctgaatggtggggctgggaggggcatatggaggagaaaggggtggctaggaaaatgttagaaataccagatacactggctctggggacccctgaggaacgacccccttcagctgccaacactttccaattggcgctaagagtgaacagctatttccactaaagatcagaaaaggactgaagtttccatacattgaagactgagccttgagattcttggctggactgcaattgcctctccctccttcccccaacgcttgctt

SEQ ID NO: 57995 - DNA, 410 bp, Homo sapiens
ttcatttttattttaggttttaaaggataagtctattttctttattgttaatttttgcagttctttattgttctcatgaaaagtaccttacatatgttgggtacactgtaaaactgattatccacatatggacatgcatacatacatcttctctctatgcaattgttaccattacttccagcattctcatccaaaatggcaaagataagggaatcaaattaggtcgctgtgggcactgtggtacaccagggactactttatggtgctcctgaaagtcttgtagtggtttggcaccagttagctgggtagtatgatcttgtcataggcttagtaaatagagtgcaatccactggctcctagcccagctgaaatctttgggcagttactgtagacttccagttagctgtgat

SEQ ID NO: 57996 - DNA, 958 bp, Homo sapiens
  misc_feature (31)..(31): n is a, c, g, or t
  misc_feature (57)..(58): n is a, c, g, or t
aggccagctctggggtccggcaggtggtccncaacatgacctctgagttcttcgctnnccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtcaaaccac

SEQ ID NO: 57997 - DNA, 800 bp, Homo sapiens
  misc_feature (31)..(31): n is a, c, g, or t
  misc_feature (57)..(58): n is a, c, g, or t
aggccagctctggggtccggcaggtggtccncaacatgacctctgagttcttcgctnnccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtcaaaccac

SEQ ID NO: 57998 - DNA, 366 bp, Homo sapiens
aaagtttagatagaatgatttctatgtaagcttttactgtgtagtctgagtccatgaatattgattacaaaaaacacatctgtaggtgagttacaatacctcacttataattcaaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacagact

SEQ ID NO: 57999 - DNA, 778 bp, Homo sapiens
gagttgatgtatcagaaagacataacaatgacagatgtgtatacgcctaataagaaagcttcaaaacgaagcaaaacaaaaattgatagaattaaagagagagataaacaaattgacaatcatgcttggaaaattgaatacttctgtcttagcagtttgcagaataactagacaaaaaacttagtaaagatgtagaacaaaattaactatcgacaaccttgacctaaatgatatgtatagaactctgcatacaacaactgaagaacataaattcctttcaggggcacacattacactaacaggctggaatcatacgctggtccataaaactagtgtcagtaaattggaaaggtttgaaaccatacagagtatgttctctggacacaaaagacttaaataaaaactctgatgagaactcagggacacaaagaaggcacctgtagacacgggggcctccttgaaggtagagggtgggaggagggagaggatcagaaaaaatagctattgggtgctaggcttacttcttgggtgatgaaataacgtgtacaaacctccccgacacgagtttacctatataacaaagctgaacatgtgcctctgaatctaaaatacaagtttagtaaaaagcaaagttgtattagaagtcagtaagactaggtgtggtgactcatgcctgtaaccccagccctttggaaggccgattcaggaggatcacttgagcccaggagttcaagaccagactgagcagcatagttagactctgtctctattaaaatta

SEQ ID NO: 58000 - DNA, 376 bp, Homo sapiens
ttatagttgatcaggagctattacatgcatcagcttacttgttctcagagttaaccttggaagatagacattatttctattctctggctaaagaataagtgacaagccttctgcaggttgggcgactcagctaaagtcattcgggtcagtgttgacagagccagaacaagagtctttcaactgcaggtctgctctttccactataaaaacagaggaaagtacaagtgaaaaagaaggggcttccaaagcagctaagtttagtccaccttctacttcacaacctaatacctaagccacccacaccaggttatctattgctttccatgttatttttttattacctaagtaatacatgaacataaacctcctttttttt

SEQ ID NO: 58001 - DNA, 257 bp, Homo sapiens
atatatacctgtacttcgaacagaaggttattttaatcgctatatctgcaggtgttttaaaaacaaccaaataacaaatgacagacttttgcaccctggactgcccttgatttactgaggagctaacctaacctaacgctttgtaagagtattgcttagcttccatgtttgactgcaacatttcgtgaggcttcgtggactgcttggactcgtactcagacctcagtttgcagagtcagtatttcagcacttgagcc

SEQ ID NO: 58002 - DNA, 375 bp, Homo sapiens
acaattatccaaggaaatctgaaatgaatattactaaatacaaccttctggatttggttttacttacctagtatgttgactatgtctgcttatggttttcttacttatgcctacctacaccatcttttaatcaaatgtgccgataaaatttctaagtgcagaatttcctttgcttgacacaaacactttgttctactgtgaatcaacttctggggctttctattgtatggatgtctacaaagggatgtgctgtaactcaagtataagcagatggttctttcattgttgtaaatcaaattggtataacctgtgactgggttcgatgtggccccagtttcctgaggcctgtgaaaattgctaggttgctcattttca

SEQ ID NO: 58003 - DNA, 651 bp, Homo sapiens
cctagtctctaaaaaaataataattagctgggtgtggcggtgcacaccggtgatcccagctacttgggaggctgaggagttcaaggtttcagtaagttatgatcatgccactgtattccagcctggctgacagagcaagaccctgtctctaaaaaacgaaaaaaactcagcaggttattctgtggatattagcaaactgattgtaatgtttataaggagaggtaaaagacccagaatagtcaactcaatattgaaagagaagagcaaggttggaggacccatagtacccaatttcagtacttttactataaagccacagtaatcaaggcagtgtggtattggtcaaaaaacagaaaaaatagatcaatgaaacagaacagagagcccagataaaaacctgcataaacatatgcaactgatctttgacaagggaacaaacacacctcaatgtagaaaggatgatcttttcaagaaatggtgctggaataactgaacatccacgtgccaaaaaaaaaaaaaaaaaaagaatctagacacccatcacaaaaaattaacttaaaatgtgtcttattctgctcagacttaaaaccacaagctgagtgcttaaaacagtaactttcctccgctccccttcccctcccgctccccgtc

SEQ ID NO: 58004 - DNA, 295 bp, Homo sapiens
gaaaactcagtattatcatgatgtcagtcctctgcttgatttacagattcaacacaatctcaatcacagtctcaggggctaagtgtggtggtttatgcctataatccagcactttgggaggctaaggcaggaggatcgcttaagcccaggagtttaagaccagcctaggcaacatagtgagaccccatatctacaaaaaaattttttttgttagctaggcctggtggcatgtgcctatattcccagctatttgggaggctgaggtgggaggactgcttgagcctaggagtctgag

SEQ ID NO: 58005 - DNA, 360 bp, Homo sapiens
taaaaaacgaaaaaaactcagcaggttattctgtggatattagcaaactgattgtaatgtttataaggagaggtaaaagacccagaatagtcaactcaatattgaaagagaagagcaaggttggaggacccatagtacccaatttcagtacttttactataaagccacagtaatcaaggcagtgtggtattggtcaaaaaacagaaaaaatagatcaatgaaacagaacagagagcccagataaaaacctgcataaacatatgcaactgatctttgacaagggaacaaacacacctcaatgtagaaaggatgatcttttcaagaaatggtgctggaataactgaacatccacgtgccaaa

SEQ ID NO: 58006 - DNA, 206 bp, Homo sapiens
ctcaaataaaataaaataaaaatcttacaaaacaataaaggacaaaaggtaacatcgcaatacagtaatttgtagaagactttacacagttcatgcaagagaaaattctcatggttaactgttatgtgaaaaagtagtccatctcaatagtactcaaagaaatataaattaaaaccacaatctgatatttgtaatcctactcaaca

SEQ ID NO: 58007 - DNA, 1165 bp, Homo sapiens
atcacagattgtgcttgtgagtcctttaataatttggagaaaatgacctgtttgaaagaagaaaactgtcatattacacagtcactccgaatgggatttctggtgtgtttttccatccttagctggcctgcagcccctgcccaggccctgctcactggtgtctttctgttgcagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 58008 - DNA, 2579 bp, Homo sapiens
cggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcggggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttggggatccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcaggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 58009 - DNA, 2486 bp, Homo sapiens
cggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagggcggcggccaagagcggggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttggggatccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcaggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 58010 - DNA, 2386 bp, Homo sapiens
cggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcggggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgaccggagccgcaggcgcccagttgcgtctacatccaccccgactcgcccaacttcggggcccactggatgaaggctcccgtctccttcagcaaagtcaagctccccaacaagctcaacggaggggcccagatcatgctgaactccttgcataagtatgagcctcgaatccacatagtgagagttggggatccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcaggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 58011 - DNA, 1672 bp, Homo sapiens
cggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcggggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 58012 - DNA, 359 bp, Homo sapiens
gaagaaaaaatatttgtgcatttggttaaaatatcaaggactggatttaccctctttccagaaacaagtaaaaactgtatacagcatttgaagcaatggcactcgacattggcatgaggcagtggatggaagtgattgctagaagatggataatgaaagaggtgactggtaagagtgccccagtgcactgcctgctacaaattgcaagctgggtttagggaggggcaatataggcagagcaagacttctcccagcattgagaaggagctgggagtttgggaaagcccaaaagtcacaagagtttacattcatttttattgctaagctacttcaatttgggtttcagtcatttttaatga

SEQ ID NO: 58013 - DNA, 1087 bp, Homo sapiens
cagagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagtttctgcatgatcttagaaatttgccaaacataaacgtgtcaacgtgaagttaagaagtgagactcacccgtccctgcacagtctatactatgccctttcgcaataggatccagtttcacctatggaatgagaaagttggggaagaagtcatctagcgtcttgctactcaaagtgtggtccatggaccagcagcatcagcatcacctgggatcttcttggaagaaatgtagaaactcaggcctcaccccagaatctgcctttttataagacccccagatgacaaaactgaaacggagaagtcacacagacggtgaattgcagagccaggagaacagccctggcagccggctctggaggtcatgctattaacctttacactctacccctcctgaagaaagatgttaaatgcagaggcaaggaaaattggtgcaaatatcattggaatgagatcactaggggttgtcctaatagggagaagaaacatcatttttcctcattctattgtcattatttcacagaccatgttgcactttgtagaaaataagtcagaaatacttgactgtgtcacattgttcaaaaggagaaagtctattacaaggcagcaatatcggagttattagtagaatttcatattgactttgtttcggttaccagaactgtcaactgcaatactggaagagggccttgcacatttctttgccaggcctgcccaacacaaagttaagaggcatgtggaaagagccaaagtttgctttcagtgatctctctgttgatattacccattcaagattttcaaccctcactccctagacaacctgtggtttctctaattatttaaaacttataaagaaattctccacaggtggatatattttttactcacttctcatctatg

SEQ ID NO: 58014 - DNA, 5650 bp, Homo sapiens
  misc_feature (1348)..(1349): n is a, c, g, or t
  misc_feature (1463)..(1463): n is a, c, g, or t
  misc_feature (1481)..(1481): n is a, c, g, or t
  misc_feature (1681)..(1681): n is a, c, g, or t
  misc_feature (1696)..(1696): n is a, c, g, or t
  misc_feature (1709)..(1710): n is a, c, g, or t
cagagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggnnccccaggccttccagggattgggaaaccaggcttcccaggacccaaaggtgaccggggcatgggaggtgttcctggggctcttggaccaagaggggagaaaggaccaataggtnccccaggaatagggggtnctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttnccaggtcccataggncccaagggggaanntgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcggtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaattttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccttgagttaaggggatagatatagatggaaaaatacacaaataaatacggtatgaaaacacatggaaatgtgtctttgtcaaatatgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagtaaatttctcatcttgttcg

SEQ ID NO: 58015 - DNA, 5836 bp, Homo sapiens
  misc_feature (1410)..(1411): n is a, c, g, or t
  misc_feature (1525)..(1525): n is a, c, g, or t
  misc_feature (1543)..(1543): n is a, c, g, or t
  misc_feature (1743)..(1743): n is a, c, g, or t
  misc_feature (1758)..(1758): n is a, c, g, or t
  misc_feature (1771)..(1772): n is a, c, g, or t
  misc_feature (5836)..(5836): n is a, c, g, or t
cagagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagggagctcacacgttcaccaactcacccttgaagtcatctcaagaacaaaagacaactgaaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggnnccccaggccttccagggattgggaaaccaggcttcccaggacccaaaggtgaccggggcatgggaggtgttcctggggctcttggaccaagaggggagaaaggaccaataggtnccccaggaatagggggtnctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttnccaggtcccataggncccaagggggaanntgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcggtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaattttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccttgagttaaggggatagatatagatggaaaaatacacaaataaatacggtatgaaaacacatggaaatgtgtctttgtcaaatatgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaattatctgttttcaattttgtctggttgaaactcttattttcaattacaaaaaaaggggggttaaattccggggcaattcgttcagtttgtaggggcatagaggataaaagagggggtaactgtggaagtcgttgaaacttctgggtatgacacaaggatattgtggccttggttattttataggagtgtgtatatttatattcn

SEQ ID NO: 58016 - DNA, 2965 bp, Homo sapiens
cagagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagggagctcacacgttcaccaactcacccttgaagtcatctcaagaacaaaagacaactgaaagacgtttccatacagttcctcgctcagaacagcttcagctgtctatgggaaggcttcacaagacaaagagctaggacttggccatttacacaaaaccaaaagtgaattacccagagtgtgctggcagagagacttgaatgtaaggacatgggaaaatctacacaggttgccaatggtttgtgactgtgagaaaagaaaagaaaaattaaagaaaatcttactagcataattcacattggacaacatgagcacattccagtcaatccactttatagacatgatctcactggtctccccaacatccctacaaggaaatgagggggaccagtatggctccacccttaggtcaaaagcccatccttcactcccacttgtggctgtgagtgggtggaacacatttaaacaggggaacaaattaccatcttccttgcttttgaccctttaacatgcgggtgagcaagtctgccttttccctgcttgaggccatacaattcccaaaacaacttgtctgaaatgttgggggctgagtcattggccagtgatagttttcaaacaactgctggtttgtttctcaaccactgcttggccatgctgacttggacacaatacagcatgtaataaaagtgcctgggatattttcctccttggcccagagaagacttttagaaggaaagacaatggtgaatacggaaggggagatgaatgcactagaaagatatgttgccagcattgtgctcagccgaagagaagctttgagaccaagaaatgtgagcatattgggcatctagaagttctcccagatagtagcgtagatctccatttttctgggttgtttattgttgttgtttgttgttgtcattttctgcactatgctgcctctcaagactcccttatgtgtgctataaaaaaaaatccatgacagaatggtctattctccacaaaaatagttactattgttgttgaggtgttactaatagttactagtagttacaaaaatagttactaatgttgttgaggtgaagtcaatgggaaagatagtagtaaaatagcaaaaatgtattagatagtatttttcacattgggaatataagacaattcattcaaaaaccaactccttaggattcattttattatcttacacttaaaaatatgtttagatttttctttcttgcactagaaattaaattgtcctatatattgagggatgaaaagcacagatgattatccgtataaatattgacacacatactcactctatccacatagctatctgttatggataaagaactcggcaacttctagcagtcatctgagatgagcaccatatgtgcattatttcactaaagctttcagagcttgagaaaaatagcctgaagaataagattgtttctttctgagccaaggttgcaatcttccaagtccaagatgtgcttgaaaatactcattaggtaattgtcaaagcctaggaagaccagtttaagaatatgaaataatattactactgacttctctttttgtgttcaatccagatggaagctggacacatgagaagtgacgtttgtataatagcaaagaaaagaacagagaacaagaaagcaaaacccttcacacctatgttctctttataggatctcattactgtttgctctctataatccccagaaaatagaaaaagtatatctatccaataagttgtggaaagtctccctctgtccttctataatagagtttccagtcattgttagacaactgcatttcattcaccaatagtggcctattgaaatcatcaacaggagaaacagttgttaatatcaaataaagagtcttgcaatggaagtcaaaatactttactctttcactaacttggtgtatgatcttgagcaagtcatttaacctctctaagtttgcttgcctcatctgtcaaacaagagagatgagataaattatctccacaggcattttcagaactattctagtctttttggaaattggtttatatttgtagaaaaggttcaatctgtttctggcatggcagtgaccaagtcagaatttctatttgggagatgagaaaaacacattaacaagattaattactgtagctgaaagatacataaatatggattggggtgtatttttaataccacaaaaacttccattcctgagttacttcattagcaactgttacttcaaccatctaggttgaggttttccagtaattctaggtcagcaattatggaccctacttattttcttttttttattatactttaagttctagggtacatgtgcacaatgtgcaggtctgttacatatgtatacatgtgccatgttggtgtgctgcacccattaactcatcatttacattaggtatatctcctaatgctatccctcccacctcccccaaccccatgacaggccccggtgtgtgacgttccccttcctgtgtccaagtgttctcattgttcaattcccacctatgagtgagaacaggcggtgtttggttttctgtctttgcgatagtttgctcagaatgatggtttccagcttcatctatgtccctacaaaggacatgaactcattcttttttatggctgcatagtattccatggtgtatatgtgccacattttcttaatccagtctaccattgatggacatttgggttggttccaagtctttgctattgtgaatagtgccgcaataaacatacatgtg

SEQ ID NO: 58017 - DNA, 5712 bp, Homo sapiens
  misc_feature (1410)..(1411): n is a, c, g, or t
  misc_feature (1525)..(1525): n is a, c, g, or t
  misc_feature (1543)..(1543): n is a, c, g, or t
  misc_feature (1743)..(1743): n is a, c, g, or t
  misc_feature (1758)..(1758): n is a, c, g, or t
  misc_feature (1771)..(1772): n is a, c, g, or t
cagagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagggagctcacacgttcaccaactcacccttgaagtcatctcaagaacaaaagacaactgaaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggnnccccaggccttccagggattgggaaaccaggcttcccaggacccaaaggtgaccggggcatgggaggtgttcctggggctcttggaccaagaggggagaaaggaccaataggtnccccaggaatagggggtnctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttnccaggtcccataggncccaagggggaanntgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcggtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaattttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccttgagttaaggggatagatatagatggaaaaatacacaaataaatacggtatgaaaacacatggaaatgtgtctttgtcaaatatgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagtaaatttctcatcttgttcg

SEQ ID NO: 58018 - DNA, 5563 bp, Homo sapiens
  misc_feature (1261)..(1262): n is a, c, g, or t
  misc_feature (1376)..(1376): n is a, c, g, or t
  misc_feature (1394)..(1394): n is a, c, g, or t
  misc_feature (1594)..(1594): n is a, c, g, or t
  misc_feature (1609)..(1609): n is a, c, g, or t
  misc_feature (1622)..(1623): n is a, c, g, or t
ggaactaaggacagaaaagtgaaatgcagtatggtgaagaggataccctgaatatgtatgaagacatgctgttgtgagacggagttgtgaaacagaggccacagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggnnccccaggccttccagggattgggaaaccaggcttcccaggacccaaaggtgaccggggcatgggaggtgttcctggggctcttggaccaagaggggagaaaggaccaataggtnccccaggaatagggggtnctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttnccaggtcccataggncccaagggggaanntgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcggtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaattttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccttgagttaaggggatagatatagatggaaaaatacacaaataaatacggtatgaaaacacatggaaatgtgtctttgtcaaatatgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagtaaatttctcatcttgttcg

SEQ ID NO: 58019 - DNA, 3402 bp, Homo sapiens
ggcacgagctccaggtgaagatgcctgtctgcgggttgtagttctgtctgccgttatacagcagtttgttaaacttcactggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcggtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaattttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccttgagttaaggggatagatatagatggaaaaatacacaaataaatacggtatgaaaacacatggaaatgtgtctttgtcaaatatgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagtaaatttctcatcttgttcg

SEQ ID NO: 58020 - DNA, 308 bp, Homo sapiens
tagaaagaactttgaaggagagttttgaaaattctgtatataattggtataggaatgtaataagaaaaaaatagaagatgctagaaactaatctgagaatgagagttgaaatatcatccagttattacttttattctgagattacattttcccttttactcctcctttcttgaattttctcctgcccttccttcaatctacctaccttccttccttccttctttccttatcctcctcctccttcctccctcttctctctcctcctcttccttagcctcctcctactactccttcctcctccttcctct

SEQ ID NO: 58021 - DNA, 237 bp, Homo sapiens
  misc_feature (2)..(3): n is a, c, g, or t
  misc_feature (226)..(226): n is a, c, g, or t
  misc_feature (230)..(231): n is a, c, g, or t
  misc_feature (233)..(233): n is a, c, g, or t
  misc_feature (235)..(237): n is a, c, g, or t
cnngtcaagcccagcagaagagataaaggtattagactggtctgtaaatttcaatgcctaaaaatatccaccaagctgtagatcttcccaagatatttttcaggaacgaagcatgtaaacttacatgagtgaaagacagtggtaaaaaaaaaaacagtctattttgggctttggctcctacctaaatctagcttgttcaataaacctgttcattaagttttatgtnaaannanannn

SEQ ID NO: 58022 - DNA, 122 bp, Homo sapiens
gaacactgccttataaaccatcagatctcctgagaactcgctttcactggaacggcttggggaaactgctcccatgatccagtcacctcccacaaggtccctccctcaacatgggggattat

SEQ ID NO: 58023 - DNA, 322 bp, Homo sapiens
tagggaaaaccactacagtgtttttagctagttatcatggagaaattgatgccttcagtctcttatctgtctactctccaatatttctactcgtggacgttccaaatagttcacttgaaagcaatatgaatgtccggagatgagggagtttatgtaaattatggggttgaaaatatacaggaaaatgtttttaataaattaaggaattgcttgttagggcacaaaactgcagaactggatatgcagctataaaattaagagcttatttacgttaaatgttcagagaaaaagactgtaaggaaatacagcaaaatgttaagaa

SEQ ID NO: 58024 - DNA, 471 bp, Homo sapiens
tttttggggatcatactaatattgaaataaatttgcatttctaagcttatattacctgatggtggggagagtacactgatgatgaagaacagtcattcttgcattaaagatttggccttagaaatccgtaaaatgaataatccatttgtagataattaagactagactacactgaatatgttgatagaccaatttcttttcaaaatctgtatggatccaatgtggcctcctaggctgtctgtcttatgtctgagaatgactggcaggtgatgcttgtgttccagccagaatgagccttcattcacagtatctggacgaatgccactacattatgttgtgttgttgaagattaagccggctttctcaaaggacttgtgctttgtagaggctcttccagatatcagcttcattgaaaatctgtcagacttttcctcctgtaggaaagttgtttgaaagtatgtccaattaaaa

SEQ ID NO: 58025 - DNA, 386 bp, Homo sapiens
tgacttgtaggctataggggctataatatatcaagacaatctttatcctcatgaagcttacagttaagtaagagatagagattaaataattataacaacagagtgaagaacagtgaagaaaaagtacagagttataatatatataatagggccaggactgcatgaggaaggtaggaaagacatttcggcaagaggttgtcagggaaaagacttgcttgagaaagagccaagttgtggggtctggctgcttagcaatgaccataatacctaacttttgctatttttacatgaagtaactaatttaaccctatgaggaaagtactactaccatctagattttacaggtaagtaagcagagatacagagaagttaaactcttcacacgg

SEQ ID NO: 58026 - DNA, 731 bp, Homo sapiens
ctaggaaataagctggatataaacatagttgtatctcctttagtgctacccagcactaaaaacttagacacgtatagggctgagcagctggtataatagagtgggctccgtctcattttctaagcctgtgagtcctagctgcctactgcagctcgatttgagtgggagttgatataatgtctttttttttttctcacttcagcagtaagtatctggtttgctcatagtcttttgattaataggtagtttgaatatttttcaaagaatcagccaacatgtgattattttaaagatttaaataccagatagatattaaaatgcaaggttattgctactagatattacatctagctaaatcaaccattgtgaaataattgagaagtagagataataaagacataaaccaataaatctttgcttgaaaatcacaggtatgggaacagattgtgaggacagaaaaataaaaagtaaaaagaaaaatcataggtaataagtgtctaaagggtttcttcataggaacagtggttgttgaccccaaataggacaaataggactcccatgttcaagaacacatcaccgttgttaaaaaggtctgccattattaaatagtgcaatgaagaaccatttagactttattagagtccacgttattggcaaaagatgttggatattcatagaaaatcaaacttgacaaattccaaaagtgtctttcagctctggaacaaaagatg

SEQ ID NO: 58027 - DNA, 377 bp, Homo sapiens
atcatcttcttgacatcataggaacctgttgatcagaggctgtaccagacacttcatcaacatcccacttaatactctgcatgcggctctccaggacagattccctcccactctgcagaggacacaggcttagagagggtgggtgaggaattaaggagctgagctgggttttgaccttgtctgactccaaagcacttgttcttcagactgcgtcttgctggcctctacagctttatgattctgggaaaagtacttacggccacgtttctttggtaagaaacaggtaattgaagaacaaaaatgaattctatatctgctttaggagaactgaaagaggctggaataactgcctttcttactgtaagatttaattatta

SEQ ID NO: 58028 - DNA, 384 bp, Homo sapiens
ccaccaagctccacagaaaattttcttaataaaacaatgggataagtgtgtacatttttaaaaggagcttcaaattaaacatttaacgaagttagaattactgctttccttgaaatgaaaatcacctggcacttgatccgcattcacctggctctatcaggcgctttcagggaagtttccagacgatggaagctcaattatgtgcttcccttgtgaggatatcacattccctctggccaatcccgggagggcctactaatgcctttggggcccagcctacaggtcccccagctaatgagctcccagggctctggaggttctcctgtgtccagcatggctggtacctgtgtcctcccagcagcccctcccttttgctgagcagct

SEQ ID NO: 58029 - DNA, 325 bp, Homo sapiens
gttttcagcatctaagtctttcacctccttggttagatttattcctaagtacttaattatcttagatgctatcgcatgcagatggagttgttttcttaattttcttttctttcctggattattttttatcttagtacctgccactacctaacattttaaatatatttatttgtctctttctgtctcatttactgaataaatcttccataaggtctaaagatttttatttgcttattgccttagtctaggatctgaaaacagtgtcaggcacatggtctagtatgtatttgttgagtgcactaatgatgaaggaacaatttactaa

SEQ ID NO: 58030 - DNA, 273 bp, Homo sapiens
ccgcggggccgattcggtttgccctttgctggcatgtcagtgaattaactgctgtccttgggatgacctgccctatgatttggcctctggagcatcccgggtgtgtatttcagaactcctcccatcttatccacctgctgaaggcctggccccctgatatggtttggctctgtttccccacccaaatctcaccttgaattttaataatccccacgtgtcatgggcgggaccaggtggaggtaattgaatcatggaggtggtttcctgaacgct

SEQ ID NO: 58031 - DNA, 297 bp, Homo sapiens
ccttgggaattgtttcttggaaattaaagcatgtgtctcacacaaacagtagaaggcattgagcattcattagtctttcctcaagaagatatcaaaatgagactagaaactctctggtgaacacagaatgctctgagggggcccaaggtacattatgaccttaaaacgaactccttctccactggccctattactcactgtggaaagcaccatgccaggcacagcaagagacttaagaacacctacaaaggaagatctctgccatccacttgtgtaattatctttaaaaagtaatcc

SEQ ID NO: 58032 - DNA, 3255 bp, Homo sapiens
gaattcggggtgcagtccccgactcgtcccggcccgttcggagccgcccgagagcgcacaaaggccgacggtttgggcgcgtgcgcgggacacgggggacgggcggtgtcacgtgatcgcgaggccgcgggcgcgcgggcgcgactcggcggcttcaacttctttttccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagccttctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaaccagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatcaaaaaaagtcgacgt

SEQ ID NO: 58033 - DNA, 773 bp, Homo sapiens
gaattcggggtgcagtccccgactcgtcccggcccgttcggagccgcccgagagcgcacaaaggccgacggtttgggcgcgtgcgcgggacacgggggacgggcggtgtcacgtgatcgcgaggccgcgggcgcgcgggcgcgactcggcggcttcaacttctttttccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactgggtaataaaagctttcttgaggaccttggactatgcccaatgcattgccttttatttttagttgctgggaagtttcagaagcctatagctaggcttctgaaatttttaatgattttagacctgaaacttagatcacagttgcttggactatgacaccaagaaagtatttgggtctcacctttcaataatgaagttgtaagtttgtcatgcagcctctgaaacttaagtagtaatagtttgagcagtagtgatagcacctaatgcatataacttact

SEQ ID NO: 58034 - DNA, 3201 bp, Homo sapiens
gaattcggggtgcagtccccgactcgtcccggcccgttcggagccgcccgagagcgcacaaaggccgacggtttgggcgcgtgcgcgggacacgggggacgggcggtgtcacgtgatcgcgaggccgcgggcgcgcgggcgcgactcggcggcttcaacttctttttccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagccttctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaagtaaccagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatcaaaaaaagtcgacgt

SEQ ID NO: 58035 - DNA, 240 bp, Homo sapiens
gcagcctgggcaacaaagcgaaaccctgactcaaaaaaaaaaaaaaaaaaagtctcttaatcacaacagcaaagctccaaaagttcaagcatcacaggtagctagtggctactatataggacagcacagacacagaacgtttccaacatcacacacagttctaatgggtagcaatgacctatactgctgaccatgctgaccaacatgtctgcagcagtccctcatccctctgtcgtcccc

SEQ ID NO: 58036 - DNA, 521 bp, Homo sapiens
caatctagaccttgagactaactgggagacagctggtgctgcagagtcacacactggctctgtgcctccagcaagccgtgtgctctgtctcccctgcttcccgccacatggagtgcagaagggaactcattcattattttaaatacaaaaaaagtaatacatgcttattgtaatagattcatgcaattcagaaaatgtaagaagtgaataacccctagaggtaatagtaacagtttggtgtgtatcctttcagacacagtgatattaatatatgtttgtgtacacatcaatatatacccacctttttaaaaagtaagaatatatttacctattctgctctgtcttttagttacttaatgtcttttcatgtcagtacatagagatctccttccttgttttcagtggtgtgcacgatttctttgtatttagccattagcctgttgatggcaatctcagttgtttctgttttctttattacaaataatgctgtggtctttaccatttgtgtacacctaacttta

SEQ ID NO: 58037 - DNA, 604 bp, Homo sapiens
tatttttcagttcagtttaacaagtttccactatcactgtggatttatgaatttctccttgcaattatgtcagtttttactttatacaaatagaggttgttattaagtgtctacaagtattgctatttttctcagttaatttttttcttattatttagttaccttttatcccaaataatgctttttgccttaaatcaattttatgtgtaaaattgactatagttacatcagctttattttggtatttgcctgctataatttttccatccttttgttttcaacattttggtatctttttaatagtatacagttggattttttttattttatacaggttgataatttctgcttctttttaaaaactagtttagtccattagtatttattgtaattaaaaatagatttagaagagaaaagatttgaacagatttgggacaccaaggaagatatatggatggaataaaagcacttggaaagacgctcaacatcctaagtcattagagaaatacacactaaaaccacaatgagataccactgtgtacctattggaatagcaacaacaaacctgttaatgccaagtgctggtgaagatatgaagacaatg

SEQ ID NO: 58038 - DNA, 448 bp, Homo sapiens
ggctatctgtagaatctagaaagagacatatattcaaattagctatgtcacatcaaaatttggagaagaagtaaaaataaagaaatttaagagatttactccaccaatctcttggtaatttttgtgttcattatcaataagctgtgtgcatccttttagagtgctactgtttgagaaaagcaacattgaagttgctgctgatcttggtcatgcattttcagagcgtgcttatcagcagacttggatgctgttggggttctctttctcatttgcaatttttccaagacaggctttctgttgcccaggctggagtgtgtagctgctgtttctcaatagacaagtcctagaagtagaaataattcaattttcattcactcttagctcttctgccactggtgttcctctttgaccctgacagggctgcacctgtcttccaggcctgatgtag

SEQ ID NO: 58039 - DNA, 1824 bp, Homo sapiens
caagaggcaggaaactgctagaggaagctgccttggagaggattctttcctcccctcccgaaaggagctgaactcaaaatctctccatttcacaatagacattggagaacattttcaacagtggatttgcaccggtgttttgtgtcctagaaaaacgttcccttcaggttcacttgaaccatctggagattggggaacaagggcaatgagttgaacatgtaggaagtttcatggcccagcccctcctgagagccctgaactgccaaccagactgagcccatcagagaataacacctcattttctgaggattctgataccttttcaatcagaaacagaagcaaagattctgcagctcccacagaaactcccagaaaccttgcggtgcttcacccttctgagatccttgagtccgaatgtgggagctaaccaggcacatcttcacaatgaaatcttcacaagctcagaaccatcaacttgctacactgtgttcctccagtgcccagttcacaggaagcactcaagagtaggatcaattgttatcaacctctagcagattattgaatagacggtcgttacatgaaactgacactcagttcttcatggtccacgatagttcttatatccagaaaacgtacttacgttatcaactctgactccataagacaactttgcaaagtcttggctcataactatgtaagcaatgagataacttagttttcatttctcacttgttacttacaagtaaacagccctgcagctcagctgagctacagattaactacaggtaatcacttcagcgattctgctttacccatgcccaagattttaaaaaagaacctgacagatcattaaattttgagatttgctttttaaaatgcaggttccataaagttacgctgttttgcttatatatacagcaacaaatgccttcttagatatttactttaaaattctagtttccttaccatgtattagccagataatctgtcattttttaaattctgaaattgtacatatataaattaatgtacatctctatgcctgaaaggtacatttggaattacaacgtgtgtcaaggtagagcaaaatcccccagtccactccttccaaccccctagaaatttactctgtttggtttcctcttgattgtctttaattaacaataagtatgtcacataggtatcaaataaaataagaaaaaaaatagataaaagagaagtgattcaaaattcaagtgtttaaacactttatgaatcttcccgttgttcttgacacatttttaaaatttcattttaattcagatcattagggatgaaattctcctgaattgtagcattttatttcctttgggaagaaggggctgaatttggcataattatacttgactatactgtaaaagaaaccagatctaatataaggacatcaatacttagttattaattcatttgcttatatttatatgtcatttgaaaatgtgtattaacatacacaattaaagggatataaaaatgaacatgccctctccatttctttaaaagaaatcaaggctgaatcaaacaggactactgttctgaaagaatactcagactatgaggtaccttattttccttcttttacacctgtctttcagttggcttcaaaaaatcatggcttttactgtgtttcttttttcctttatgtcttccttttgagggaaatgaaaaattgagaaaggaaattattattttataagtgggtgggtttgaatacatctttcacagtcaaatatttttctatgccttatgagcttaaaaaataaatttagaaagtttgataaacacaga

SEQ ID NO: 58040 - DNA, 1947 bp, Homo sapiens
ttaaattatactttaggttttatggtacatgtgcacattgtgcaggttagttacatatgtatacatgtgccatgctggtgcgctgcacccactaactcgtcatctagcattaggtatatctcccaacgctatccctcccccctccccccaccccagaacagtccccagagtgtgatattccccttcctgtgcccgtgtgatctcattgttcaattcccacctatgagtgagaatatgcggtttcttaatatgtgtttcttaattgtgcatcctgctggggttgagaacagaaattgaaaaacacaattgttttatctctccttccccgaggagttgaacatgtaggaagtttcatggcccagcccctcctgagagccctgaactgccaaccagactgagcccatcagagaataacacctcattttctgaggattctgataccttttcaatcagaaacagaagcaaagattctgcagctcccacagaaactcccagaaaccttgcggtgcttcacccttctgagatccttgagtccgaatgtgggagctaaccaggcacatcttcacaatgaaatcttcacaagctcagaaccatcaacttgctacactgtgttcctccagtgcccagttcacaggaagcactcaagagtaggatcaattgttatcaacctctagcagattattgaatagacggtcgttacatgaaactgacactcagttcttcatggtccacgatagttcttatatccagaaaacgtacttacgttatcaactctgactccataagacaactttgcaaagtcttggctcataactatgtaagcaatgagataacttagttttcatttctcacttgttacttacaagtaaacagccctgcagctcagctgagctacagattaactacaggtaatcacttcagcgattctgctttacccatgcccaagattttaaaaaagaacctgacagatcattaaattttgagatttgctttttaaaatgcaggttccataaagttacgctgttttgcttatatatacagcaacaaatgccttcttagatatttactttaaaattctagtttccttaccatgtattagccagataatctgtcattttttaaattctgaaattgtacatatataaattaatgtacatctctatgcctgaaaggtacatttggaattacaacgtgtgtcaaggtagagcaaaatcccccagtccactccttccaaccccctagaaatttactctgtttggtttcctcttgattgtctttaattaacaataagtatgtcacataggtatcaaataaaataagaaaaaaaatagataaaagagaagtgattcaaaattcaagtgtttaaacactttatgaatcttcccgttgttcttgacacatttttaaaatttcattttaattcagatcattagggatgaaattctcctgaattgtagcattttatttcctttgggaagaaggggctgaatttggcataattatacttgactatactgtaaaagaaaccagatctaatataaggacatcaatacttagttattaattcatttgcttatatttatatgtcatttgaaaatgtgtattaacatacacaattaaagggatataaaaatgaacatgccctctccatttctttaaaagaaatcaaggctgaatcaaacaggactactgttctgaaagaatactcagactatgaggtaccttattttccttcttttacacctgtctttcagttggcttcaaaaaatcatggcttttactgtgtttcttttttcctttatgtcttccttttgagggaaatgaaaaattgagaaaggaaattattattttataagtgggtgggtttgaatacatctttcacagtcaaatatttttctatgccttatgagcttaaaaaataaatttagaaagtttgataaacacaga

SEQ ID NO: 58041 - DNA, 496 bp, Homo sapiens
gaggcaggaaactgctagaggaagctgccttggagaggattctttcctcccctcccgaaaggagctgaactcaaaatctctccatttcacaatagacattggagaacattttcaacagtggatttgcaccggtgttttgtgtcctagaaaaacgttcccttcaggtaggttctaataagccccactgggacattttggacacccttgtctgctctctgcctctctaaccttagagggtcccttggaatcaactaatatttcaggtcctttcttcccattactgttgccacacaaggaacccagattacatcagggagaggctgagctccagaggttcacaccaggagcttattcattgtcacactgttcctgcttcctgacaggttcacttgaaccatctggagattggggaacaagggcaatgtgagtattcatgaaattcaaatcatgccaagtattccgggatgggaatggttgtctcagaggtgtgctctgt

SEQ ID NO: 58042 - DNA, 695 bp, Homo sapiens
ttggtaggatacattgtctgatgacaataccgagcatgtggcattttgttctgtgtctcacagtatcaccatgacactgactgaaaaataccctggtttctgcaaggtgtctgatagatcaggcaagattaaataaagataattacccctgagtttttctattttttacattccatttagagaggtttggttactgcccttggtgaatttggaagctcctatatatgatatccagatcttcctaccagacatgaatatgatctgactcctaacctctcattctgatatagccttctgtcagcctccttagccagtttgatatttttattgtttatttacttattttttacccttttttcaagaaatggggtctcacagtgttgcccaggctggacttgaactcccactcctgggctccagcagtcctcctgcctcacctttccaagtagctggggctataagtacacaccaccatgcccagcaatatttttatttctgtaatgtgtcatttagccagtgattgttgtattataatagaatcacagaaatggagggactcctagaggtaatcaaatctggtggtttttaagccttttattccctctaaagggatagtaaaaccattaaaaatataatttatcccaatatgtaagtcagagaaagctgaacttctggtttagagaggaacacagatg

SEQ ID NO: 58043 - DNA, 231 bp, Homo sapiens
ggaactataagatggtgatagcagtgaccaacacacagtatagctctctaaagggtagtagttagtccctctctcacttgacctacctgttatacctgcacacacacacacacatgcatgcatacacatacagacacactcaagcatgcacatacaattgcatacattctcacatctcaaacatgtaagagccaagcacaattggtacatttggtcgaaccacataggtga

SEQ ID NO: 58044 - DNA, 303 bp, Homo sapiens
aggaacaggagatcagcagggtaaagaactgtctgaaacgactctcctttcttcctgcctaccatgtatatattgattgtttcctaaatggaaatggagaaaatggattagggtctcttgactatgtatttagaatttattcaattcattcagtcagcaagtagtacttatcgataggtagctatgtgtctaggcatttagggaatacagccagatagaaaacagatagattctagtatagcattttacaataagtgaagtggataaaagaaaagttacagattacagcctttctttctctcc

SEQ ID NO: 58045 - DNA, 556 bp, Homo sapiens
aacagaagtgttgtgatctggcttacagtgagcagagatcgcgccactgcactccagcctgggccacagagcgagactccgtctcaaaacaaacaaacaaactacaagccagatcacaacacttctgttaaaaaaaaaaatcccagaatttctcatttcttccctagattctatgtgatctgccactctcaggactcagcatgttcctgctttgctgaccttgctgttcttcccacacaccaagctcattgccgctcatttacatttgctgtctcatctgcttggagcattgcctccagggtctttgcaggtttgtgtcttctcatcctttaggtccctgctgaaataccacttccctgattaccctatcagaaataccaacccttctcacattaaagtggttctgattctgctttgttttccacagcatttagcacaaccagaaatgatttatgttttgcttctgtttataagttctctgattataagttctgtgaggacagagactgtctttgtcttgtttactgctgtctcgagcatctaaaatagtgcctgg

SEQ ID NO: 58046 - DNA, 1212 bp, Homo sapiens
atttcagagcttacaggttaggagttcaggcaccatttcattgagtcctctgcttcacagtttctctgaaaccctggaaggctgaaatcaagttattggtcagggctgttcttatctgaaggcctgagtggggaaggatctgcttccaagctcacttaaattgttagcagaatttcttttctttcctttctttttttttgagacagagtctcgctgtattgccaggcctgagtacagtggctcaatctcagcttaccgcaacctccgcctcctggttcaagtgattctcctgcctcagcctcctcagtagctgagattacaggcgcacgccaccatgcccagctaatttttttatttttagtagagacagggtttcaccatgttggccaggagggtctctatctcttgacctcatgatccacctgcctcagcctcccacagtgctggcgtttgagccaccatacctggcctgttggcagaatttcaattccacaagggttgctggcttccggggttccactagctgactgttggctggaggttgccctcacttccttgccacacgagcctctataacatggcagctttcttaagcaaagtaaacaaggattagagtctgctagccagatggaagttacagtctcatgtagtctgatcacagaagtgacatttcatcacctttgccgtaatcttttggttggaagcaagtcactaggctagcccatattcaagggagggagttatacaaaggcatgtataccagaaggcagacatcattgaatcattgaacagatcctagaatctatctgccacagtgctcagttgagaagaagaaaggaaaattctaggtaaaaaaggcaatattactaagtggttaagtgtgatgatgtcaaagtcacagatctgcacttgactgtcaactctgacaagacagcctcccagctggcatccctgcttccccctctgtcccctctccaatccattctgcatgcagtcatcagcttgatcatttgaaaatgccaaatctccctcactcttgacatttcctaacctaaagagtgggagagtagtgattgaaaagagagaaactgccttctgttcagtaagatgtactccctgcactgaccaccaaggggtgtcattgctctttcctggttaagccagttaccacacttgggaagggctagtggcaatgtgaggtgatttggggca

SEQ ID NO: 58047 - DNA, 2014 bp, Homo sapiens
tggcaatgaggaggggtggagtgagatatgtcctggctagaaaatccttgtgtttaaaagctaggagatagttgaagacagggaggaaaaaacattccagacaaaaaataacatggaagggacattgaccagaattgacacgacatttggggaatcgcagccagttaaacaggagaatatggactggggaatatgagagaagaactaatggaaggatttggggaggctggtaatattggcagcagagtttgggtagagggaagacaggagattccatccctaatcaaggcaagggatgatgggagtctgaattaagcagtagtagaatgagagggcctgtatttcaccaattacaaggtgtacttccccccccccccacattttggtgtctgtcaaacttggacacttctaaaagtcaatggcatgtcacagtttaagtggcattttttctttcttagagctacataaaagaatcataacaagctgggcgcagtggctcacgcctgtaatcccagcactttgggcggctgaggcgggcggatcacgaggtcaggagattgagaccattctggctaacatagtgaaatcctgtctctactaaaaatacaaaaaattagccgggcgtggtggcgggcgcctgtaatcccagctactcgggaggctgaggcaggagaatgtcgtgaacctgggaggcgaagcttgcagtgagccgagattgcaccactgcactccaacttgggcaacagagcaagactccatctcaaaaaaaaaaaaaaagaatcataacatagcatcttacatttgatgaagcatggcacattgaaagtacaatcgattgccatcttgttaataaaatgtcagagggattagaggaaagactcttagatgatgcttgaatttctggcttgagtgtctgcattgaatagtggggatcccctcaacaaaattttcaggaggaggaggatatccctgttattttccagaataatcagtgatactctgtgatattgataatctaccttgttggcccttaccaagttactggggtgtgagtaacagctgactgtagctccctttctctaccctagtgctctggaaggaggaaaggagagctggcttgtatcttactttctcaagttatcagtccacaaacatgaagagtattagtgttacagatacaaagatgataactactgtcttatgagcctttattctgctaagtgtatccattatctcttttaatcttcacacaacccaccatcaatgaggtatatagtattcttatgttacacagcaggaacatctcagagattctgaaactggcccgtggttatacagatgggaagtggtagaggtcagattcagacacagtcctgtttgagtctgaccataaccttaatcctgtttgggccaattaagacagtcgtaaaagatctcagtatagagctataaagaagttaaatcacaaaagtgataaagtaagtttttttttgtttgtttgtttttttgagacagcctgggccacagagcgagactccgtctcaaaacaaacaaacaaactacaagccagatcacaacacttctgttaaaaaaaaaaatcccagaatttctcatttcttccctagattctatgtgatctgccactctcaggactcagcatgttcctgctttgctgaccttgctgttcttcccacacaccaagctcattgccgctcatttacatttgctgtctcatctgcttggagcattgcctccagggtctttgcaggtttgtgtcttctcatcctttaggtccctgctgaaataccacttccctgattaccctatcagaaataccaacccttctcacattaaagtggttctgattctgctttgttttccacagcatttagcacaaccagaaatgatttatgttttgcttctgtttataagttctctgattataagttctgtgaggacagagactgtctttgtcttgtttactgctgtctcgagcatctaaaatagtgcctgg

SEQ ID NO: 58048 - DNA, 1625 bp, Homo sapiens
atttcagagcttacaggttaggagttcaggcaccatttcattgagtcctctgcttcacagtttctctgaaaccctggaaggctgaaatcaagttattggtcagggctgttcttatctgaaggcctgagtggggaaggatctgcttccaagctcacttaaattgttagcagaatttcttttctttcctttctttttttttgagacagagtctcgctgtattgccaggcctgagtacagtggctcaatctcagcttaccgcaacctccgcctcgctgaggcaggagaatgtcgtgaacctgggaggcgaagcttgcagtgagccgagattgcaccactgcactccaacttgggcaacagagcaagactccatctcaaaaaaaaaaaaaaagaatcataacatagcatcttacatttgatgaagcatggcacattgaaagtacaatcgattgccatcttgttaataaaatgtcagagggattagaggaaagactcttagatgatgcttgaatttctggcttgagtgtctgcattgaatagtggggatcccctcaacaaaattttcaggaggaggaggatatccctgttattttccagaataatcagtgatactctgtgatattgataatctaccttgttggcccttaccaagttactggggtgtgagtaacagctgactgtagctccctttctctaccctagtgctctggaaggaggaaaggagagctggcttgtatcttactttctcaagttatcagtccacaaacatgaagagtattagtgttacagatacaaagatgataactactgtcttatgagcctttattctgctaagtgtatccattatctcttttaatcttcacacaacccaccatcaatgaggtatatagtattcttatgttacacagcaggaacatctcagagattctgaaactggcccgtggttatacagatgggaagtggtagaggtcagattcagacacagtcctgtttgagtctgaccataaccttaatcctgtttgggccaattaagacagtcgtaaaagatctcagtatagagctataaagaagttaaatcacaaaagtgataaagtaagtttttttttgtttgtttgtttttttgagacagcctgggccacagagcgagactccgtctcaaaacaaacaaacaaactacaagccagatcacaacacttctgttaaaaaaaaaaatcccagaatttctcatttcttccctagattctatgtgatctgccactctcaggactcagcatgttcctgctttgctgaccttgctgttcttcccacacaccaagctcattgccgctcatttacatttgctgtctcatctgcttggagcattgcctccagggtctttgcaggtttgtgtcttctcatcctttaggtccctgctgaaataccacttccctgattaccctatcagaaataccaacccttctcacattaaagtggttctgattctgctttgttttccacagcatttagcacaaccagaaatgatttatgttttgcttctgtttataagttctctgattataagttctgtgaggacagagactgtctttgtcttgtttactgctgtctcgagcatctaaaatagtgcctgg

SEQ ID NO: 58049 - DNA, 411 bp, Homo sapiens
atctcagagattctgaaactggcccgtggttatacagatgggaagtggtagaggtcagattcagacacagtcctgtttgagtctgaccataaccttaatcctgtttgggccaattaagacagtcgtaaaagatctcagtatagagctataaagaagttaaatcacaaaagtgataaagtaagtttttttttgtttgtttgtttttttgagacagcctcactgtgttactcaggctggagagcagtagctcagtcatagcccactgcagccttgaactcctgggctcaagcgatcctcctgccttagcctcccaagtagccaggactacagatatacaccaacatgtccagctaattaaacatttttttttttgtagagatgaagactcaccatgttgcccaggctagtccc

SEQ ID NO: 58050 - DNA, 1937 bp, Homo sapiens
  misc_feature (1)..(1): n is a, c, g, or t
  misc_feature (3)..(5): n is a, c, g, or t
nannngggcacgagagaggacagagagcaagtcactcccggctgcctttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58051 - DNA, 2071 bp, Homo sapiens
gtttaactggcacatgtggctggaaatgcaagaagagggaaacgtgtggcttggagtttcaagaagagtgactgtctcagtgccgagtgcctcagcagcttctccacatgctcttcagtccccaaagttggagaatcccatcaaggagagtagccctgtaaggaattcgaatttccagcatttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58052 - DNA, 2230 bp, Homo sapiens
gcaatccagtgtgtaggtccagggcgacaagcgctgctcccgtggctggggtaagtccctccagcattcagccttgctccctgtgcttatctggatgcggtgtaggatgaagatgaccctatagaactctaccctggaagtcctggcaaagtggatatgtgacattttttaaaccagggacatgttggtgctgcttaatatttaaatcataattttcagactcttaaaaattactaaataagtttgaagagacacagccatctgcctacagtgccacccctgagcttcacgccaccctggtctccaggaaaggggagagtctcaggaatattgaatgcagttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58053 - DNA, 2272 bp, Homo sapiens
gtttaactggcacatgtggctggaaatgcaagaagagggaaacgtgtggcttggagtttcaagaagagtgactgtctcagtgccgagtgcctcagcagcttctccacatgctcttcagtccccaaagttggagaatcccatcaaggagagtagccctgtaaggaattcgaatttccagcatgtgccttcaggagccagactgcaggaattcaactgtggcctcatctgactacagcaggtgtggagtcttggttcagttgtgcagcctctctgcgcctcggtcttctcatctgttaaagggagtaatagtagtcctgacaaggttcttatgaagattaaatacgagaaccaggcaaagagcttaacgtggttcttggcacatttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58054 - DNA, 1837 bp, Homo sapiens
gtttaactggcacatgtggctggaaatgcaagaagagggaaacgtgtggcttggagtttcaagaagagtgactgtctcagtgccgagtgcctcagcagcttctccacatgctcttcagtccccaaagttggagaatcccatcaaggagagtagccctgtaaggaattcgaatttccagcatttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctgggggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58055 - DNA, 1823 bp, Homo sapiens
  misc_feature (1)..(1): n is a, c, g, or t
  misc_feature (3)..(5): n is a, c, g, or t
nannngggcacgagagaggacagagagcaagtcactcccggctgcctttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58056 - DNA, 1906 bp, Homo sapiens
gtttaactggcacatgtggctggaaatgcaagaagagggaaacgtgtggcttggagtttcaagaagagtgactgtctcagtgccgagtgcctcagcagcttctccacatgctcttcagtccccaaagttggagaatcccatcaaggagagtagccctgtaaggaattcgaatttccagcatgagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58057 - DNA, 1006 bp, Homo sapiens
cctgagctgaggcaggtggggagaggggagaggtggtccagtctagggtacttggttatcagccctttcatttgttctctaaaaccagggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaa

SEQ ID NO: 58058 - DNA, 348 bp, Homo sapiens
tatttctaaatgttttctaatgtccattatcatttcttctttaacacatagtttataagatttttactttttagcgtgcagctattttgctatcatttggtcctgagatctaactcaatgaggctgtaatcagagaatgtggcccttatgatattggtccctgaaatgtgttggggctgtctttagcacctaccaggggtcaactttcataaatgaatcgtgtatttgaaaataattttttatattaattggggtgcaatattctatacatatcccattataggggaagttgttaattttgctgtgcaatttttctatatcccttactaatttttccccttctgcttg

SEQ ID NO: 58059 - DNA, 301 bp, Homo sapiens
tgctgttcttttttccctccaaaacaaattcatctgtcagaaaactgaagttatctttctaagtctggctcttcattcattatttggtaacatttttgtttgtttttaaatctttttttacattaatatagatggggttttgccatattggccaggctggtcttgaactcctagcctcaagtgatctgcctgcctcagcctcccaaagtgctgggattaccgatgtgaggcacccgggcccagccaatttggtaatattttagtgttgtagttatcttgacttgaaacccaagaggcatct

SEQ ID NO: 58060 - DNA, 450 bp, Homo sapiens
ggaaagtcccttccctcaaggcactggcacatcccagggaacatcgacatatacccaactaattataaaaataatagagaacaaggagagaaggatgttaacatgggcaaggcccagaggcataaggtgtgatgaggagcagtgagtacatctatgtggttggaatgtatggtgtgtgctggaaagcctgggagttatatttggtctattggaactggaagctgtatatcagctctatatcaaaactgggaattatatttggtctgcattattttcctgcagaagaagggattctggccctcagagagggtgaataccttgcccaacatgagacagtactcaaacccagctcgcccaaaagtaaaacccagctcggtagctcccaccacattcttccacctctccatgttacctgtactacctggatgtggcctgtccacatccaagctc

SEQ ID NO: 58061 - DNA, 375 bp, Homo sapiens
tttttttgagtcagagtctcactctgtcacccagactggagtgcagtggcacaacctcggctcattttaacctctgcctcccaggttcaagcgattctcgtgcctcagcttcccaagtagctgggactacaggcacacgcaaccatgcatggctaatttttgtttttttagtagaaacagggtttcaccatgttagccaggctggtctcgaactcctgacctcaagtgatctgcccgcttcagcctcccaaagttctgagataacaggtgtgagccttagcgcctagcctataaaccctcctttaagagagtacttcataaagggcaaaggaacttccaaatcaactacctgagtccattactttctgagctggg

SEQ ID NO: 58062 - DNA, 453 bp, Homo sapiens
agcccagccactgccccttggcacatcagcacaaaaggctgaaatcattgctcttacccgagcattaattttgggacaaaataaaaagcttaacatctatacagattctaaatatggcattccttgtggttcacgcttatgctgcaatctagaaagaaaggggactactagctagcaaaccctcccccataaagcatgggcctgaaattcttcagctattgtaaacaatacacctgccacaggccatagctataatccattgtagggggcatcaaagggacttaactcctatagcacaagggaacagaaaggttgatagagaagccaaagccacatccctcagggtgcaatcccaacagatcctagcactgattcctttctatgattcccagtggatcccaaatacacactacaggaagaacagttaataaaggagcaagtggggcaaaaaaa

SEQ ID NO: 58063 - DNA, 919 bp, Homo sapiens
cagctcctccctgagtcttcagctgcaacaatctaaaactagaacatgagctcctccctgagtctccagctgaaagaccctcaacgtgaacatcagctcctccccgagtcctcaacagcgcgaccctcaaactacaacatcagctcctccccgagtcttcagctgcatgaccctcaatctagaacatcagctcctctccgggtctgcagctgcaagaacctaaaactagaacatcagctcctccctgggtctgcagctggaagatccactaactagaacatcagctcctgtccgggtctccagctccatgaccctcattcaagattatcagctcctccaagtctccagtgaaagaccctcaacgcgaacaacatcagctccaccccgagtcctcaactgcacgaccctcaaactacaacatcagctcctccccgagtcttcagctgcatgaccctcaatctagaacatcagctcctctccggatctgcagctgcaagaccctcaaactagaacatcagctcctctccgggtctgcagctgcagggccctgaaggtagagcatcagctgctccccgagctagaacacctgtcccacctggatctccagctccacgaccctcacagaagaacagccacactggctccttcattgtcttcagctccacaacctaagacatcagtggcagcaccggctcctccctggacgtccagctcaacgactctcatagacttaaaaggcagcacctgctcctccccaaggctccaactccaccaccctcggatttgaacagcggtagcaccacctcctctccaggtcttcagccccacgtccctccctgaacaatcccttcttgtgaaattcagcagtcaagaaatctgcagcgaaagtaaatgaataaatgttttgttttcaagtcta

SEQ ID NO: 58064 - DNA, 504 bp, Homo sapiens
gggatcagagagagggaggaactaggaaggcacattcatttataaagaagctaatgaaacatggactacgaactagaaattccaagttggccagagatagggaatctacagtagctagacatttatggatgttcgttctgggtctgctcaacccaaaactacatactggtgggaatacaagagatgaatactcggttctggtctccttgcatttataccctggctttaaagctgagcttaaatgtcaacctccttcagagccatctaagactgtactgattctattttagaacaggccaaatttcaggggtgagggacttagggattctgaggatctctcccagtgcactgctctgaaaatatggtaggcctgggccagctgctgggacaggtcacaagccatcaccacaaacatttatccagagagttcatgtttagcacaatcctaaatgtttcagagaaaactaaaaatatgcagtctctctctgattcataggctcagta

SEQ ID NO: 58065 - DNA, 354 bp, Homo sapiens
tttattaagaaagtaaggggataaatgggtgactacttcataggcagagcagccctcatgggctgctggctggctttattcatgattatttcttgattatatgctaaatatggagtggattatttatgagttttctagggaactgggtgggaaattcctggaattgagagttcttccccatttctgaccatatagggtaacttccagacattgttgtggcattcttaaactgtcctggcgctggtgggagttccttttagcatgctaatgcgttataattagtgtataataagcagtgaggatgacagtaggttgttttcgttgtcatcttggttttggtggggtttggctggc

SEQ ID NO: 58066 - DNA, 268 bp, Homo sapiens
atgcctcagtttcctcatctgtaatacagggacagtaaaagtagccatctcatgggctgttgtgcagattaacatatcgggctaagttagtatttgtaaagctcttagtggtacatagggctatggaaaagcattgtctaaatcaatcggaggcttcgttgttgcaaagatataatatctccctaagcctatttataaatgtaatgcaatcacaacaaagaacttaagagttttgtacctggacaatttgaacctcaaattgatatgg

SEQ ID NO: 58067 - DNA, 446 bp, Homo sapiens
ctctgtggtctactcttttgtgcacacccacccacctcttccccagctgacactgctggaggaggagagggagagatgtcatctcctcctatggcaacctgtgggatagcaaccgcccttttcctgctgggtgtaatctgctgccatctcttgctgtctgcagcctgacagagaagggtgaaggtcaccaggttccactgataggggtctttgtctcaagcggcaaccctaggaccgagggtcccttgcaagattcagtcacatttcatgactgtctgcaacacaccccatgcctctgatggaaggaacacaatgccccatgctgcactcatttctgccagactacagtccctgatctcaatttccctctgcagtccccaactctggggtctgcagacacatttcagatccctcctttgtacctcccaggaggcagaagccagagg

SEQ ID NO: 58068 - DNA, 813 bp, Homo sapiens
caaaaaaaaaacaaaaaaaaaaaaacacaagttaaaacttcccatgtataaaaacacttacattttaaaacatcactgccaacgtgtgtgtgctcatgtgggagtacagatgtgtatatacagacatgtacatttttaaagacttggttgtctctgcagtgaagacaatatgttttattttttattccatatacttctctgtattttctatatttgcttcaataagctggtgtaacttttaatttttttaattaaaaaaaatttagcgtaaaattacacttaaacattagcagctgctgctgggaaaaaatggacaaattgcccaggcagccacattagaagaagaaagtcatttgaatacagttatatacttatttttattgagacacatcttgctgtgtcacccagggttttgctctgttgccacagcttactgcagccgtgacccaggctcaagtgatccctcccacctcaggcccctctccccgaccagtagccgagactacaggcaggcacagactggcaccaccacactcggctaattttttttttttgaggcagggtctcactatattgtccaggctggtcttgaactcctgagctcaagtgatcctctcaccttggcttcccaaagtgctgggattacagacaagtcatggcagctggctgagtacagttattcagcataagcataacaaaaacagaatggcagcccagttcctttgttaatgaaatagtaagggtgtaactagggcaagctggccctgtttatgtcacatgagtttgttttagaaagcattcttgagaacacaa

SEQ ID NO: 58069 - DNA, 384 bp, Homo sapiens
gtcatagtgaacaatgctgtgagaagcatcctagtcactaaacgattccttgggcgtagttttctgttgtcgatatgatcctatggcgagtctcacaggcttccttcatagttactaagagatcgttgctgatacgtacgaaagattaatgctgtgtttttatttggctgcttcgctgaacgtgtagtcgtttgagggatgtttcagttgattccacggactgactgggtttccaccagaatcagcagagtttccaattaactgcgatcatctgcccttgccatggatgccttgggccgtctgggtttccttccaagactaaagggtctgctcccctgctgctgggagtgctggctgcgagagcggtcagctggggtcccttct

SEQ ID NO: 58070 - DNA, 415 bp, Homo sapiens
tatgaaaatagttttcctgaaaaagacaagggaagcagcagcagcattctcctttccccacacccatatacacgcctgtgccctgtaactgaagtgtgagaggcacagtgtcataaatgggtagatagtaagtggggactaaaactgtcaagggtgatctaattggggtgggctcatagtagtacttctgtgtgaatgctttggtggacccttaaggtactacatggaccagcctgggcaacatgatgagaccctgtctctacagattaaaaaaaaaaatttttttttttttttaaattagctgagtatggtggtgtgtgcctgtagtcaggaggctgaggtgggaggatcacttgagcttgggaggtcgaagctgcagtgatcacaccacggcacttcagcctggatgacagag

SEQ ID NO: 58071 - DNA, 392 bp, Homo sapiens
gaataaatccaaattgtgaatgcttaaaatatactttacagaatattaaaatttaaaagcatcacaggaaaaatattaatactgttttcagaatttcagtatgtgaataatatttacattacagtttcatatgaaccttttacttctctatttagtatgccttcatgtcactgcagaggtatgaaaaggagagctctcctagttgtgaaaaaagaaacatgttttattgggagctaagtggaaggttgaacatgtgggaatatctgggcatgcactgaagacaccttttgcatctcccccatccacatagcaaagtgaatgtggtttgtgtccatttatgcaggatactctggaaaaccaaactgaagcaaggttaacatacatttttaaaa

SEQ ID NO: 58072 - DNA, 3215 bp, Homo sapiens
ccacgcgtcgcggagggagccgaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagc

SEQ ID NO: 58073 - DNA, 3089 bp, Homo sapiens
ccacgcgtcgcggagggagccgaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagc

SEQ ID NO: 58074 - DNA, 2325 bp, Homo sapiens
agagacgagagacattacactgattctgaaggcgaagctaggcatgccccagtttctgagcactgaagcccagagcctcttgcgggccctgttcaagcggaatcctgccaaccggctcggttcctcgtctcaatgggagatgatgatcccaagcttgcttcagggctctgttgatgaaatgaggttgtgtgaacatgccggcatgtagctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagc

SEQ ID NO: 58075 - DNA, 1478 bp, Homo sapiens
ggttattcctatttctcagcagggaaactgaggctcagagagttgaaggaacttgcccagggcactcatttgatgagtgcagaaggcaagttttgaacctgaatctgtctgagcccaaacatgaggcttttcccaccttcccacatggctttttgaaggcaaaggagaaatggaagggtgttccaggacgaagggcctagagcagcaaaggcccagcgacaggaaccttggctgtgtgcggggagccctggagcagagtggagaatggatcccaggggctgccgcaagggttcaggcgggagctagcaggagatggttgccctcctgtgccccatcaggggcctgctcccctgcagccctcccacaacccccttgcccactgtgtccccaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagc

SEQ ID NO: 58076 - DNA, 2522 bp, Homo sapiens
ccacgcgtcgcggagggagccgaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggtgagtctgtacggcctgcgtgggcttatttggaggagggaggcagggtcccatcctagggcttttcagcagttcatgaacagcctcatttctccaagcggatgttccacaaatccctgttgctgtatttctccaagcggaagattcccaggcagaccaccaccacctccgcaccttgttggggtaacctggtgatcattcattggcccttctcattctggaccctgtggggcactgagggctgcatcatcacagtcccggctttgtggaaacgtagtgtagtgagggatacaggtttgcacacaaggggcagagatgcctggaggcacagataggcggatgctcttggccaggggtgtggaccgtggagacacagagcagagcaactggccat

SEQ ID NO: 58077 - DNA, 1396 bp, Homo sapiens
ccacgcgtcgcggagggagccgaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaagtgagtgaagcctccagccccaccccagcctccccaggggaggcctcttctaggacagggccatcctgaggtgggtgggcatggctttctccagaaacgtctccctctcttgggcaatctgagggatgggtgagtggggtgggtggtagtgccagctgcccagtcactaatgctaccattaccaagggccaggtactttgcatgcaggtaatgttgcccgtctttttttgctaatctagtgtgacatttgagatgccacctttagaggtctttccttgataaagccctatagaattttccctaatatctaactaccctcaaatgataactaaggagccaggggcaggtggtgagttggaataagatctggctttagtgttaggcagccctgtattcaaatcctgtctccacctactagctagacttactagctcaatgactgtagagctacttaactgccctgagccttagttttcccattagcaaaacggggccctaatagtacttgcctcacacagttgcttcaaggattagcaaaaaagataggcaacacccctgcgtggtactgctaccaccctgcaacacccgcccagtcatcagagagaattgggtggagcacctcctctgggctgaacccaac

SEQ ID NO: 58078 - DNA, 3113 bp, Homo sapiens
cagccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagc

SEQ ID NO: 58079 - DNA, 3612 bp, Homo sapiens
ccacgcgtcgcggagggagccgaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagcaaaaaaacacaacaacaaaacaaacaaaaacaaaaaaaaacaaaaggggcggggcccttaataaatttcccccgggggggccaaagaatctagcggagtggtccccacgtttgctttggtcaacaagtggggtcccccaatatggcagcagtgctatattgaaacgtaaagacgtgggcccgcttctttcaacacacgctccgtaactcgcgaaaaaagcgtcctctgatatgggcaatcttggggaaggcaacccattattccggggggtggagcctatagtggacacaacatcctacgacatttaaagcccacgagtaaattacaattccacggtttcacgggtaccaacatgaaaatcatgcgctgaaatggcatcggactatatcgaatttca

SEQ ID NO: 58080 - DNA, 2288 bp, Homo sapiens
ccacgcgtcgcggagggagccgaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgatggaagacgacggcaagcctcgtgccccgcaggcacccctgcactcggtggtacagcaactccatgggaagaacctggtttttagtgacggctacgtggtaaaggagacaattgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagc

SEQ ID NO: 58081 - DNA, 695 bp, Homo sapiens
cgagctcggtaccccgatgtctctgccgatgtcacagtcgacgtcccgggtcatcgatggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagc

SEQ ID NO: 58082 - DNA, 750 bp, Homo sapiens
atcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttt

SEQ ID NO: 58083 - DNA, 183 bp, Homo sapiens
gaattccaattttttttgcattctcagcagcagttgtttttatctttttgtttatagccatcctagtgggtatgaggcagtatttctttccttcttcttcttcttttttttttttcgagaccgagtttcgttcttgtcgcccaggctggagtgcagtgatgcaatctcggctcactgcaacct

SEQ ID NO: 58084 - DNA, 816 bp, Homo sapiens
gaagacaccctgtgccatgtggaggggccctgccctctggggcaagaggtcagggaggagggcgctggctgggttcccaggcgcctgcccctgagaggcgcaaatggccctaatggggttattaggtggagcagatgcgtccggctcctgctgtggaggaaatgctcaaatgatcttgaagctaccaggctgggagaggcaggcaggggatggggcagacaggctgccaacctctgtgagataagccctggcctctccagaaccttttcagaacagctatgagccccaaccctggggctgagtgacccaagacagatcactcacactctctgggcctcagtttccccttacataaaaagcaatggttaggccaggtgcagatggctcacacctctaatcctagtgctttgggaggccgaggtgggaggattgcttgagaccaagagttcaagtccagcctgggcaacatagcaacaccccatctctacaaaacataaatacaaaaattaaggccgggcatggtggttaaggccaggcgtggtggctcacacttggaatcccagcattttgggaggcagaagcaggaggatcacctgaggtcaggagtttgagaccgacctggccaacatggtgaaaacccgtctctatacaaaatacaaaaattagccagccatggtggtgcatgcctgtaatccctgctgctgtggaggctgaggcgggagaatcacttgaacccaggtgaaggaggtttcagtgaggcccggatcgatgccactgcactccagcctgggtgacagagaacaagactgtctcaaa

SEQ ID NO: 58085 - DNA, 498 bp, Homo sapiens
agtgcagtggcacgatcatagctcactgcagccttgaacccctgggttcaagcaatcctcccacctcagcctcccaagtagctgggattataggtatgtgccaccacccagctaatttttttattttttgtagagatggggtctcgccatgttgcccaggctagtttggaactcctgagctcaagagatgctcccaccttggcctcccaaagtgctgaaattacaagcatgagccaccatgcctggcctcccttcctggccttctgcaggctggtcttaaactcctgacctcaagtgatcctcccgcttcggcctccccaggtgctgggattgcaggcatgagccaccgcacccagcggggacaggacaattttgccagctggagaaggggtggcccccaaatgtccccttcaccaccctcctgcctcttccttcagaacactttttccctgaagcccctcctgaatagctgggattacaggcacccgccaccatgcc

SEQ ID NO: 58086 - DNA, 584 bp, Homo sapiens
gaagacaccctgtgccatgtggaggggccctgccctctggggcaagaggtcagggaggagggcgctggctgggttcccaggcgcctgcccctgagaggcgcaaatggccctaatggggttattaggtggagcagatgcgtccggctcctgctgtggaggaaatgctcaaatgatcttgaagctaccaggctgggagaggcaggcaggggatggggcagacaggctgccaacctctgtgagataagccctggcctctccagaaccttttcagaacagctatgagccccaaccctggggctgagtgacccaagacagatcactcacactctctgggcctcagtttccccttacataaaaagcaatggttaggccaggtgcagatggctcacacctcccaaagtgctgaaattacaagcatgagccaccatgcctggcctcccttcctggccttctggtctccagactggagagagggccacaaagtcctgcccagacagagggctgctaaggctggggtggggctgggggtgtgcagaagggactctgcaggggctgacctctgagtctcaggggacagggcaaat

SEQ ID NO: 58087 - DNA, 1173 bp, Homo sapiens
gaagacaccctgtgccatgtggaggggccctgccctctggggcaagaggtcagggaggagggcgctggctgggttcccaggcgcctgcccctgagaggcgcaaatggccctaatggggttattaggtggagcagatgcgtccggctcctgctgtggaggaaatgctcaaatgatcttgaagctaccaggctgggagaggcaggcaggggatggggcagacaggctgccaacctctgtgagataagccctggcctctccagaaccttttcagaacagctatgagccccaaccctggggctgagtgacccaagacagatcactcacactctctgggcctcagtttccccttacataaaaagcaatggttaggccaggtgcagatggctcacacctctaatcctagtgctttgggaggccgaggtgggaggattgcttgagaccaagagttcaagtccagcctgggcaacatagcaacaccccatctctacaaaacataaatacaaaaattaaggccgggcatggtggttaaggccaggcgtggtggctcacacttggaatcccgcttcggcctccccaggtgctgggattgcaggcatgagccaccgcacccagcggggacaggacaattttgccagctggagaaggggtggcccccaaatgtccccttcaccaccctcctgcctcttccttcagaacactttttccctgaagccctcctgggtagccccctacccacatgcctcagcattgggaggtggggagtatgggggtcccccttctcctcagccccatttggagtaatgtcctgtgcagctgagctcacaactcctcctccacctgtccctccacccggtgtcactggcaattgctcacttcctgggcctgcacccactcagctcccctatccctggggcatcagcctcagccagctcccatgtggactaatgacccttgtccctcccctcagctgcctctcttttttctttttttttttgtttttgagacagagtctggctctgtctcagaataaaaaatgccacatcatatgatagtcacacagaaaaatgctaaggtgttatctgcccgcgttctgccttttttccacaccggcacggaggagccacgttgttcggtggtccttcggaacttgtgatttgcaggtgacatcctcgg

SEQ ID NO: 58088 - DNA, 838 bp, Homo sapiens
ggctggggtacaatggcacgatctcggctcactgcaatctccgcctcctgggttcaagtgattctcatctctcagcctcccgagtagctgggattacaggagtgcaccaccatgcccagctgatttttgtatttttagaagagattgggcggggtggggggtggggtgcgggtttcaccgtgtggcccaggctggtcttaaactcctgacctcaagtgatcctcccgcttcggcctccccaggtgctgggattgcaggcatgagccaccgcacccagcggggacaggacaattttgccagctggagaaggggtggcccccaaatgtccccttcaccaccctcctgcctcttccttcagaacactttttccctgaagccctcctgggtagccccctacccacatgcctcagcattgggaggtggggagtatgggggtcccccttctcctcagccccatttggagtaatgtcctgtgcagctgagctcacaactcctcctccacctgtccctccacccggtgtcactggcaattgctcacttcctgggcctgcacccactcagctcccctatccctggggcatcagcctcagccagctcccatgtggactaatgacccttgtccctcccctcagctgcctctcttttttctttttttttttgtttttgagacagagtctggctctgtctcagaataaaaaatgccacatcatatgatagtcacacagaaaaatgctaaggtgttatctgcccgcgttctgccttttttccacaccggcacggaggagccacgttgttcggtggtccttcggaacttgtgatttgcaggtgacatcctcgg

SEQ ID NO: 58089 - DNA, 995 bp, Homo sapiens
catgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatca

SEQ ID NO: 58090 - DNA, 378 bp, Homo sapiens
tcgattccattcgttgatgattccattcgattccattcaataattctattcgattccatttgatgatgattcaattctattacactggatgcttctattcgattccatttgatgaggactccattcgattccatttgatgatgattccattcgattgcattcaatgatgattccattcgagtgcattcaaagattacattcgatgccattcaatgatgattccattcgagtccattcgatgatcccattcgattccattcgatgatgattccattcgagtcccttcgatgatcccattcaattccattcgatgatgattccatttgagtccatttgatgattccattcgattccattcgatgatgcttccactcgagt

SEQ ID NO: 58091 - DNA, 288 bp, Homo sapiens
gtagagacagggtttcaccatgttgcccaggttggtctcaaactcctgggctcaagcaatctgcctgcctcagcctcccaaagtgctgggattataggcatgagcccccatgcctggcctataaaccattcttatctggtaatatacacagcctttaaaggtttctattgtattctcatactcctcatctgaagtacaaatatgtttcttaaaaacataaaatatatttcaattaatattccatattttaatatttttattttcttaaactgtttttctgccaagtcg

SEQ ID NO: 58092 - DNA, 325 bp, Homo sapiens
ttgcatacctgtgctgtgtcagcaccaggcagagtcatctcattccactggtctaatggatggcaattgaatttaattaacaaaactcctttggacttagtttcatactgtgctgaatgtaatggaatcctctctgccccccttatctctctctctttcactctctctcaactaaaaattgtccttaactaacatccactttaagaatattaaaggctatacattatacttaaaagatacaatacagtcatccccctttccatgacttaaattgtataacataaaataattaaaaagatactttgatagtgatacacagtataga

SEQ ID NO: 58093 - DNA, 326 bp, Homo sapiens
tcagcaggctgtttaaaaggggggatgaaatgttatagaatttgattgtggtaatggttgcataacctaatgaatagaccaaaaacatcgacttgtatacttcatgtggttgaactgcacagtatgtgaattagatctcaataagctggtttttaaaatggcaaaatggaatagaaggtggtctgggtggcactactattcccatgattccaaaagtgacacaacagaagtggctccaagattttagaagaaaaatcccctggggcacccaggcaagcaggggaatgagggcagctgtgaggttctgtagatgccaccagcacctc

SEQ ID NO: 58094 - DNA, 442 bp, Homo sapiens
ccttggccttcccggggggcgggaggccctcgggacaggacgcgctgtccccggagtccggagctcaggccagtggcagtcgacccagcccccgagactccctcacgccgctccaaaaccaaaacggagcccaacacgaagctgggtgaagccgtagcttgcaggagccagggagatgcgctctgcccgggacttcccgggtcctgttgagacggaaaggatcgcagggaagacaggataattggtctttaactctgaccgttaccttcgaaattgcaccttacaagcatgtcctctatttccgtggcttgatggggacactttctctgattaagatccggaataatcacccacccaatgggatctcttagagggaagcgctggttagaatcccctctttggtcggtacctgagactgcatagacctaaactgaaaggtgat

SEQ ID NO: 58095 - DNA, 1066 bp, Homo sapiens
gtttcaccgtgttagccaggatggtctccatctcctgacctcgtgatccgccctcctcagcctcccaacgtgctgggattacaggtgtgagccatcgcgcctggccaaaagggagttcttatattggcagtgtatcatgattaaagttatcctccctctttctctccctcccacatatatattttcgtgtcagtatatgtatatgtgatttgtgctatttgtgtgtgtgtaggtaaatgaaagtggcatcaagagaatctcacattaaaaaaaatttgagatagtacaattcttatgcatcatatgttgcataacgtttgactattaagaaatttgcatcacacgtctacttatttcattaaacatgttacagtcaattaattcacttacaccctccatttccttcttccccctctctcgttctcctgctgcagggtcattatacgttcctactcacaaaatgtccttgttttttcccttactcctgtcattgatcttctgaatctttccggcgaacttaacatggatgttttgatagaaagctctggcattaactctggagttgttttgcaaggaaggttgttcgctttttcaccattttttttttttcaggtccttgaagtgttttcacatagatatttcacaagagccatttcagaattgagaacatttggcgtgcactcttcctcttttggtcccacagtttttatgtgtcctacttgaaattatgtttgctcccgtttcaattgtaatattgcacttactcattagtttttagtttgaactctcctgcgaggtctaatgtagagtttggacaagaacacagattcataataaacctacccagtcaatttggtataaaggcttagaaggtggaactggccacattttgaattggaggtaaggatcaggaatgctaatggagagacataggattttcttatggaaacaagaaacaaataacctctgggcagtattagagcccagagagtgataagcctcttctaacttcaatattctatgtacaaattcacaagactttttttttctttcttttttttgagac

SEQ ID NO: 58096 - DNA, 149 bp, Homo sapiens
cacgccgccttccatctccacgccgccttccatctccacgccgccttccatctccacgccgccttccatcactggcatcacctgcctccctgcttgtttccttttcagatcaaatcctataattacagctgtatttaaacactgttaaa

SEQ ID NO: 58097 - DNA, 458 bp, Homo sapiens
agggaccagacagcttcccgactgcagtgtctttggatggggctggtggggaagcccacctgtgggagcaactccaagtctgtttcctcgatgggaacaataatgtcgacttgattgggttattacaaggattaatagtatgtttggaccacctagcacggggcctggcacacaatgcttgatgcatagcaggtgttcaaaaaatgctggtttcttcttctcttccattctttcctatcattcttcacctcatacttattgactgataagatttttaaaaactcttccttcatccatctttctgttacccaaaagagctaggagatgggggtgttttgcaggactagcctaagtttaaatgtgcacatggtacaatcagggtattaaagccatgtgagtcttcatgggtaggcacgtaacctctggagaaagcccacaagtgcagaaaggctccttcc

SEQ ID NO: 58098 - DNA, 1556 bp, Homo sapiens
agatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctat

SEQ ID NO: 58099 - DNA, 1685 bp, Homo sapiens
  misc_feature (74)..(74): n is a, c, g, or t
  misc_feature (135)..(135): n is a, c, g, or t
  misc_feature (177)..(177): n is a, c, g, or t
  misc_feature (180)..(180): n is a, c, g, or t
agatttccctccttcgtcgctgttgctgccgccatacgcgctctccctgtttagctcttctgttagaaatagtntcttgttttcctttgctgttcctcaatcccctactcttcaccccttgttttcacctatttngcgagaacccatccagatcccccttcccttcttcccctgccngcncagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctat

SEQ ID NO: 58100 - DNA, 1553 bp, Homo sapiens
  misc_feature (74)..(74): n is a, c, g, or t
  misc_feature (135)..(135): n is a, c, g, or t
  misc_feature (177)..(177): n is a, c, g, or t
  misc_feature (180)..(180): n is a, c, g, or t
agatttccctccttcgtcgctgttgctgccgccatacgcgctctccctgtttagctcttctgttagaaatagtntcttgttttcctttgctgttcctcaatcccctactcttcaccccttgttttcacctatttngcgagaacccatccagatcccccttcccttcttcccctgccngcnccagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctat

SEQ ID NO: 58101 - DNA, 1335 bp, Homo sapiens
agatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctat

SEQ ID NO: 58102 - DNA, 967 bp, Homo sapiens
  misc_feature (74)..(74): n is a, c, g, or t
  misc_feature (135)..(135): n is a, c, g, or t
  misc_feature (177)..(177): n is a, c, g, or t
  misc_feature (180)..(180): n is a, c, g, or t
agatttccctccttcgtcgctgttgctgccgccatacgcgctctccctgtttagctcttctgttagaaatagtntcttgttttcctttgctgttcctcaatcccctactcttcaccccttgttttcacctatttngcgagaacccatccagatcccccttcccttcttcccctgccngcncagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcct

SEQ ID NO: 58103 - DNA, 766 bp, Homo sapiens
ttcccaaattgccttcttagaaggttgtatcacctctgacaaaaatctgaatattcttaatgtttgccaatttgacaggtaaaaaaggttcttatttttgtttcagtttcagtctactgattactagtgtcctaatcagcttgagtttctataacaaaataccacatacagactgggtggtttaaacaataagcacttactcgtcacagttctggaggctgggagtcggagaacaaggtgccgacaggtcgacagtgtttttcttaacgatatttataactgctctttacacaggctagtaacctttgatctatatgctgtcaatactttccccaagttcaatttactttcaattttgttgaaggtggattttgacatattgaactatattccactcaaaacagttttttcctttataatgttaaccttcctcaaactaagattacattttttaaagaaattatttcattttttcacatttaggtaattaatctgaactttatgtttgtttgcaatatgaggtagagatataatgttctcccaaagtcagagaaatgtatcatttccctcatttccctaatacatatatgttacacccatcataaattcatacagatacacacatacactcttctttctgttctatacctgttttaacatccaatcactattttaatgtcacatacattaagtctcaccatattagtgttgatttctttttcttttttctcttttttcttgagacagaattttgctcttgtcgccc

SEQ ID NO: 58104 - DNA, 295 bp, Homo sapiens
cagagctggtcagactgtgacaaatacagattaattctgaaatggaagccttgcattataactttttatagagaattgtacaagcattataaggataattaaatatattgccagtgttgctacatgatgctcttaaaagactaaagtgaatttattagtgagtacaagtatattgcaaactggtttataccttcaaaaagatatattccctgttcactttatttccaatagtgttaaaaaccactgagccaggcaaggaagaccatactgtcttcagcatatttaaagcagtttg

SEQ ID NO: 58105 - DNA, 1909 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtagggctcaggcatcacacccacccgtgccagggccctactgtccctggggtcccaggctctccttggagggggctccccgccttccacctggctgtcatcgggtagggcggggccgtgggttcaggggcgcaccacttccaagcctgtgtcccacaggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcacctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58106 - DNA, 2005 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggtaagcaaggctccgtccaggctgaggggcgtgccggtggcagctcggggccctggaggctgaggggagccctggcggctcttgtacgtgtttcaggcatcttccagtacgagaccatctcctgcaacaactgcacagactcgcacgtcgcctgctttggctataactgcgagtagggctcaggcatcacacccacccgtgccagggccctactgtccctggggtcccaggctctccttggagggggctccccgccttccacctggctgtcatcgggtagggcggggccgtgggttcaggggcgcaccacttccaagcctgtgtcccacaggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcacctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58107 - DNA, 1781 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggtaagcaaggctccgtccaggctgaggggcgtgccggtggcagctcggggccctggaggctgaggggagccctggcggctcttgtacgtgtttcaggcatcttccagtacgagaccatctcctgcaacaactgcacagactcgcacgtcgcctgctttggctataactgcgagtagggctcaggcatcacacccacccgtgccagggccctactgtccctggggtcccaggctctccttggagggggctccccgccttccacctggctgtcatcgggtagggcggggccgtgggttcaggggcgcaccacttccaagcctgtgtcccacaggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58108 - DNA, 1750 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcacctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58109 - DNA, 1765 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccggtaaggggcgcgaaaccgaggcggggcccccccaccccgggacaccccgcccaccgcctgagcctgaccttctcctgcctcgacgactcagggtatttccccaacgagctgcgaaacatcttccgggagcaggtgcacctcatccagaacgccatcatcgaaagccgcatcgactgtcagcaccgctgtggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcacctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58110 - DNA, 1021 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagagaccacgctcctctgccttctcctggcctgggacacacagagccaccccggccttcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58111 - DNA, 965 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58112 - DNA, 932 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacatcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58113 - DNA, 1276 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggtaagcaaggctccgtccaggctgaggggcgtgccggtggcagctcggggccctggaggctgaggggagccctggcggctcttgtacgtgtttcaggcatcttccagtacgagaccatctcctgcaacaactgcacagactcgcacgtcgcctgctttggctataactgcgagtagggctcaggcatcacacccacccgtgccagggccctactgtccctggggtcccaggctctccttggagggggctccccgccttccacctggctgtcatcgggtagggcggggccgtgggttcaggggcgcaccacttccaagcctgtgtcccacaggtcctcggcgcagtggaagtcagctgtccagggcctcctgaactacataaataactggcacaaacaggacacgagcatgagagaccacgctcctctgccttctcctggcctgggacacacagagccaccccggccttcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58114 - DNA, 1841 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccggtaaggggcgcgaaaccgaggcggggcccccccaccccgggacaccccgcccaccgcctgagcctgaccttctcctgcctcgacgactcagggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcacctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58115 - DNA, 1114 bp, Homo sapiens
tggttggtgcgcggctgaagcgggtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccagcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgaaaaaa

SEQ ID NO: 58116 - DNA, 690 bp, Homo sapiens
cttgcctcctacatcctcctcaccttgcctaagtcaccacagatggcctcctcactactgtccctgctctgcctccgctccctcctggacagagggtctgcttcaaacccttgatgtcactcctggccggcattcacccaagtccccaccctcagtcacatccgaggtcggcatatttttctctaagggtctgataggaaatattttaggccccgtggccgtggggtgttcgttacactccctgctttgctgcagtgtgaaaggagctggaggcaacacatgaaccacataggggctgcgttccagtagaactggggacactaaaatttgaatttcacataattttcacatgccatgaaacatttttttttcagtcattaaaaataaaaaccaggtgggtgcggtggctcacacctgtaaacccagtgcttagggaggccagggtaggatcacttgaggccaggagtttgagaccagcctgggcaacgtaggcaagaccactgccccaccaccccatctgttttaaaaattagctgggtgtggtgcgtgcctttggtcccagctacttgggaggctgaggcaggaggatcgcctgagcctaggaagctgaggctacagtgagccaagattgcaccactgcactccagtctgtgctacagagcaacaaacaccgtgtctcaaaacaaacaa

SEQ ID NO: 58117 - DNA, 190 bp, Homo sapiens
ggaacacggtgaaaaattcatatctcaaaagcacagagctgagactttgggcctaaatactgtaccactggttccctaaaccaaggaagaaaagtgtcggtaaaggcccggttaagacaagatggcaaggaaaagcaccttaaacaatggtaagatttatgttagatcagtggtaagagtttctagtgac

SEQ ID NO: 58118 - DNA, 341 bp, Homo sapiens
tgggaagatcaggtcttacttgtttttctgtcccctccagcgctagatcaacacagtgttaaattagttgaatttcagtggaggagataagacagaaatgaaatctgtgaagattcagactttcccaagttaaaaccagtcttgagttacagatcaagatgatgccagaaataacatcacactgaaacatcagtcaaatgtagtcatcatggcaaaggccaaatgtccctttctttttttgcctccgcctgcctgggaatttagcatcccctaaagccactcatctgggacaggattttagggtgtgtacatgtttttcatctccacaggaccagctgtgt

SEQ ID NO: 58119 - DNA, 435 bp, Homo sapiens
aacaagagtggaggaaattttcagactggtcccttctctggctgtaacaccctggccaagtgtctcaacctccctaagcctagcgccctcacctgttcaacagcaataatcaggcctgtcttgcctacctcactagattattgcaagcagtgaagggacgtgaacaggctctggcaaccagaaagcacagtcataattccaaataacatgatgaaaagaaaatgtggctgatattgttaatttcccaaggaaatctgtgtagtcctctgactcattttgcaaagactggagaggaaatggagaaggaagcacaccagagccaacactttgaaaggaggttgttcattccatcactttcgaaatggagattctgtcctcctggctgtgtggcacatgattgctgtccaataaacaggaattgatgaatggctgagt
